US008119147B2

(12) United States Patent
Emery et al.

(10) Patent No.: US 8,119,147 B2
(45) Date of Patent: Feb. 21, 2012

(54) COMPOSITIONS PRODUCED USING ENTERIC PATHOGENS AND METHODS OF USE

(75) Inventors: Daryll A. Emery, New London, MN (US); Darren E. Straub, New London, MN (US); Laura Wonderling, Minneapolis, MN (US)

(73) Assignee: Epitopix, LLC, Willmar, MN (US)

( * ) Notice: Subject to any disclaimer, the term of this patent is extended or adjusted under 35 U.S.C. 154(b) by 607 days.

(21) Appl. No.: 10/946,647

(22) Filed: Sep. 20, 2004

(65) Prior Publication Data

US 2005/0186217 A1 Aug. 25, 2005

Related U.S. Application Data

(60) Provisional application No. 60/504,119, filed on Sep. 19, 2003.

(51) Int. Cl.
A61K 39/112 (2006.01)
A61K 39/02 (2006.01)
A61K 39/116 (2006.01)
A61K 39/00 (2006.01)
A61K 38/00 (2006.01)
C07K 1/00 (2006.01)

(52) U.S. Cl. ........ 424/258.1; 424/234.1; 424/190.1; 424/203.1; 424/184.1; 514/1.1; 530/350; 530/825

(58) Field of Classification Search ............ 424/234.1, 424/258.1, 190.1, 203.1, 184.1; 514/2; 530/350, 530/825
See application file for complete search history.

(56) References Cited

U.S. PATENT DOCUMENTS

| | | | |
|---|---|---|---|
| 4,167,560 A | 9/1979 | Wohler, Jr. | 424/92 |
| 4,452,775 A | 6/1984 | Kent | 424/425 |
| 4,626,416 A | 12/1986 | DeVoe et al. | 423/12 |
| 4,663,161 A | 5/1987 | Mannino et al. | 424/450 |
| 4,681,761 A | 7/1987 | Mietzner et al. | 424/92 |
| 4,748,018 A | 5/1988 | Stolle et al. | 424/157.1 |
| 4,871,488 A | 10/1989 | Mannino et al. | 264/4.6 |
| 4,981,685 A | 1/1991 | Healey | 424/92 |
| 5,141,743 A | 8/1992 | Schryvers | 424/234.1 |
| 5,292,869 A | 3/1994 | Schryvers | 530/413 |
| 5,439,808 A | 8/1995 | Blake et al. | 435/69.1 |
| 5,534,256 A | 7/1996 | Potter et al. | 424/184.1 |
| 5,538,733 A | 7/1996 | Emery et al. | 424/422 |
| 5,578,314 A | 11/1996 | Cochrum et al. | 424/424 |
| 5,587,166 A | 12/1996 | Donachie | 424/422 |
| 5,688,682 A | 11/1997 | Mulks et al. | 435/252.1 |
| 5,830,479 A | 11/1998 | Emery et al. | 424/255.1 |
| 5,885,589 A | 3/1999 | Foged et al. | 424/255.1 |
| 5,906,826 A | 5/1999 | Emery et al. | 424/422 |
| 6,027,736 A | 2/2000 | Emery et al. | 424/257.1 |
| 6,348,198 B1 | 2/2002 | Schryvers et al. | 424/190.1 |
| 6,432,412 B1 | 8/2002 | Emery et al. | 424/241.1 |
| 6,682,754 B2 | 1/2004 | Emery et al. | 424/426 |
| 6,692,739 B1* | 2/2004 | Patti et al. | 424/130.1 |
| 6,720,160 B2 | 4/2004 | Wolde-Mariam | 435/7.32 |
| 6,790,446 B2 | 9/2004 | Jacobs et al. | |
| 6,869,607 B1 | 3/2005 | Buschle et al. | 424/184.1 |
| 7,026,157 B1 | 4/2006 | Stojiljkovic et al. | 435/320.1 |
| 7,138,124 B2 | 11/2006 | Emery et al. | 424/234.1 |
| 7,138,125 B2 | 11/2006 | Emery et al. | 424/234.1 |
| 7,147,857 B2 | 12/2006 | Emery et al. | 424/184.1 |
| 7,148,191 B2 | 12/2006 | Egyed et al. | 514/2 |
| 7,160,549 B2 | 1/2007 | Emery et al. | 435/69.3 |
| 7,341,732 B2 | 3/2008 | Emery et al. | |
| 7,371,393 B2 | 5/2008 | Emery et al. | |
| 7,413,743 B2 | 8/2008 | Emery et al. | |
| 2003/0036639 A1 | 2/2003 | Emery et al. | |
| 2003/0064073 A1 | 4/2003 | Emery et al. | |
| 2003/0206922 A1 | 11/2003 | Emery et al. | |
| 2003/0211118 A1 | 11/2003 | Emery et al. | |
| 2004/0197350 A1 | 10/2004 | Emery et al. | |
| 2004/0197869 A1 | 10/2004 | Emery et al. | |
| 2004/0265329 A1 | 12/2004 | Emery et al. | |
| 2005/0095682 A1 | 5/2005 | Staub et al. | |
| 2005/0220788 A1 | 10/2005 | Nagy et al. | |
| 2006/0024323 A1* | 2/2006 | Emery et al. | 424/190.1 |
| 2006/0165718 A1 | 7/2006 | Emery et al. | |
| 2007/0098733 A1 | 5/2007 | Emery et al. | |
| 2008/0293080 A1 | 11/2008 | Emery et al. | |
| 2009/0081236 A1 | 3/2009 | Emery et al. | |
| 2009/0123500 A1 | 5/2009 | Emery et al. | |
| 2009/0162402 A1 | 6/2009 | Emery et al. | |

FOREIGN PATENT DOCUMENTS

CA 2029906 9/1990
(Continued)

OTHER PUBLICATIONS

Baumler et al. J. Bacteriol. 180: 1446-1453, 1998.*
Field et al., "Influence of Iron on Growth, Morphology, Outer Membrane Protein Composition, and Synthesis of Siderophores in *Campylobacter jejuni*," *Infect. Immun.*, Oct. 1986;54(1):126-132.

(Continued)

Primary Examiner — S. Devi
(74) Attorney, Agent, or Firm — Mueting Raasch & Gebhardt, P.A.

(57) ABSTRACT

The present invention provides compositions including polypeptides having the characteristics of polypeptides expressed by a reference microbe such *E. coli* or *Salmonella*. Examples of *Salmonella* strains that can be used include, for instance, *S. enterica* serovar Newport, *S. enterica* serovar Enteritidis, *S. enterica* serovar Typhimurium, and *S. enterica* serovar Dublin. Also provided are compositions including polypeptides having a particular molecular weight and a mass fingerprint that includes polypeptide fragments having a particular set of masses, or polypeptides having an amino acid sequence with at least about 95% identity with an amino acid sequence, wherein the polypeptide has seroreactive activity. The present invention also provides methods of making and methods of using such compositions.

9 Claims, 33 Drawing Sheets

FOREIGN PATENT DOCUMENTS

| EP | 0 287 206 A1 | 10/1988 |
|---|---|---|
| WO | WO 90/11349 A1 | 10/1990 |
| WO | WO 90/12591 A1 | 11/1990 |
| WO | WO 95/21627 A1 | 8/1995 |
| WO | WO 96/01620 A1 | 1/1996 |
| WO | WO 01/37810 A2 | 5/2001 |

OTHER PUBLICATIONS

Schwartz et al., "Iron-regulated Proteins in Outer Membranes of *Campylobacter jejuni* Diarrhoea Isolates and Immune Response to the Proteins in Patients," *Zentralbl Bakteriol.*, Jan. 1994;280(3):338-347.

Acheson et al., "Protective Immunity to Shiga-Like Toxin I following Oral Immunization with Shiga-Like Toxin I B-Subunit-Producing *Vibrio cholerae* CVD 103-HgR," *Infect. Immun.*, Jan. 1996;64(1):355-357.

Alberti et al., "A Porin from *Klebsiella pneumoniae*: Sequence Homology, Three-Dimensional Model, and Complement Binding," *Infect. Immun.*, Mar. 1995;63(3):903-910.

Alurkar et al., "Immunomodulatory Properties of Porins of Some Members of the Family *Enterobacteriaceae*," *Infect. Immun.*, Jun. 1997;65(6):2382-2388.

Ames, "Resolution of Bacterial Proteins by Polyacrylamide Gel Electrophoresis on Slabs. Membrane, Soluble, and Periplasmic Fractions," *J. Biol. Chem.*, Jan. 25, 1974;249(2):634-644.

Anwar et al., "Antibody response to acute *Pseudomonas aeruginosa* infection in a burn wound," *FEMS Microbiology Letters*, 1985;29:225-230.

Arockiasamy et al., "Purification of Integral Outer-Membrane Protein OmpC, a Surface Antigen from *Salmonella typhi* for Structure-Function Studies: A Method Applicable to Enterobacterial Major Outer-Membrane Protein," *Analytical Biochemistry*, 2000, 283:64-70.

Arp, "Response of turkeys to *Escherichia coli*," *Poultry Digest*, pp. 142 and 146 (Apr. 1984).

Ashkenazi et al., "Safety and Immunogenicity of *Shigella sonnei* and *Shigella flexneri* 2a O-Specific Polysaccharide Conjugates in Children," *J. Infect. Dis.*, Jun. 1999;179(6):1565-1568.

Ausubel et al., eds., *Current Protocols in Molecular Biology*, John Wiley & Sons, Inc., 1998; cover pg., publication pg., and table of contents only (12 pgs.).

Babu et al., "Effects of live attenuated and killed *Salmonella* vaccine on T-lymphocyte mediated immunity in laying hens," *Vet. Immunol. Immunopathol.*, Jan. 10, 2003;91(1):39-44.

Banerjee-Bhatnagar et al., "Expression of *Neisseria meningitidis* Iron-Regulated Outer Membrane Proteins, Including a 70-Kilodalton Transferrin Receptor, and Their Potential for Use as Vaccines," *Infect. Immun.*, Sep. 1990;58(9):2875-2881.

Bannerman et al., "The bovine innate immune response during experimentally-induced *Pseudomonas aeruginosa* mastitis," *Vet. Immunopathol.*, 2005, 107:201-215.

Bokete et al., "Genetic and Phenotypic Analysis of *Escherichia coli* with Enteropathogenic Characteristics Isolated from Seattle Children," *J. Infect. Dis.*, Jun. 1997;175(6):1382-1389.

Bolin et al., "Passive Immunization with Antibodies against Iron-Regulated Outer Membrane Proteins Protects Turkeys from *Escherichia coli* Septicemia," *Infect Immun.*, May 1987;55(5):1239-1242.

Boothby et al., "Characterization of antigens from mycoplasmas of animal origin," *Am. J. Vet. Res.*, Mar. 1983;44(3):433-439.

Bosworth et al., "Vaccination with Genetically Modified Shiga-Like Toxin IIe Prevents Edema Disease in Swine," *Infect. Immun.*, Jan. 1996;64(1):55-60.

Bouchet et al., "Immunological Variants of the Aerobactin-Cloacin DF13 Outer Membrane Protein Receptor IutA among Enteric Bacteria," *Infect. Immun.*, Jul. 1994;62(7):3017-3021.

Bradley, "Bovine Mastitis: An Evolving Disease," *Vet. Journal*, 2002, 164/2:116-128.

Bragg et al., "Organization of Proteins in the Native and Reformed Outer Membrane of *Escherichia coli*," *Biochim. Biophys. Acta.*, Aug. 9, 1972;274(2):478-488.

Brogden et al., "Lysates of turkey-grown *Pasteurella multocida*: Effects of solubilizing agents on the immunologic properties of membrane vesicles," *Am. J. Vet. Res.*, Mar. 1983;44(3):428-432.

Bruckmaier et al., "Changes of physiochemical indicators during mastitis and the effects of milk ejection on their sensitivity," *J. Dairy Res.*, 2004, 71/3:316-321 (abstract only).

Butterton et al., "Coexpression of the B Subunit of Shiga Toxin 1 and EaeA from Enterohemorrhagic *Escherichia coli* in *Vibrio cholerae* Vaccine Strains," *Infect. Immun.*, Jun. 1997;65(6):2127-2135.

Calnek et al., Diseases of Poultry—9th ed., pp. 99-130, Iowa State University, Ames Iowa (1991).

"CDC National Antimicrobial Resistance Monitoring System:Enteric Bacteria", datasheet, [online]. Centers for Disease Control, Washington D.C., 2002. [Retrieved Apr. 13, 2005.] Retrieved from the internet: <URL:http://www.cdc.gov/narms/; 7 pgs.

CDC *Salmonella* Surveillance Summary, 2002. Atlanta, GA: US Department of Health and Human Services, Centers for Disease Control, 2003. Title page; publication page; table of contents; pp. i-x.

CDC *Shigella* Surveillance: Annual Summary, 2002. Atlanta, GA: US Department of Health and Human Services, Centers for Disease Control, 2003. Title page; publication page; table of contents; pp. i-iv and 1-21.

Charles et al., "Adjuvanted subunit vaccines for the control of *Salmonella enteritidis* infection in turkeys," *Am. J. Vet. Res.*, May 1994;55(5):636-642.

Chart et al., "Antigenic and Molecular Homology of the Ferric Enterobactin Receptor Protein of *Escherichia coli*," *J. Gen. Microbiol.*, Jun. 1985;131(6):1503-1509.

Chart et al., "Iron-regulated Outer-membrane Proteins of *Eschericia coli* Strains Associated with Enteric or Extraintestinal Diseases of Man and Animals," *J. Gen. Microbio.*, Jun. 1988; 134(6):1549-1559.

Choi-Kim et al., "Relationship between the iron regulated outer membrane proteins and the outer membrane proteins of in vivo grown *Pasteurella multocida*," *Vet. Microbiol.*, Jun. 1991;28(1):75-92.

Cohen et al., "Double-blind vaccine-controlled randomised efficacy trial of an investigational *Shigella sonnei* conjugate vaccine in young adults," *Lancet*, Jan. 18, 1997;349(9046):155-159.

Corbett et al., "Effect of Iron Deprivation on Outer Membrane Proteins of *Pasteurella multocida*," Abstract, published in the Abstracts of the 85th Annual Meeting of the American Society for Microbiology, Las Vegas, Nevada, Mar. 3-7, 1985 (13 pgs).

Coster et al., "Vaccination against Shigellosis with Attenuated *Shigella flexneri* 2a Strain SC602," *Infect. Immun.*, Jul. 1999;67(7):3437-3443.

Coulton et al., "Protein II Influences Ferrichrome-Iron Transport in *Escherichia coli* K12," *J Gen Microbiol.*, Jan. 1979;110(1):211-220.

Courcol et al., "Siderophore Production by *Staphylococcus aureus* and Identification of Iron-Regulated Proteins," *Infect. Immun.*, May 1997;65(5):1944-1948.

Crichton, "Chapter 3. Microbial iron uptake and intracellular release" In: *Inorganic Biochemistry of Iron Metabolism*, Burgess, (ed)., 1991, Ellis Horwood Limited, Chichester, England, Title page and pp. 59-76.

Crist et al., *Mastitis and its Control*, [online]. University of Kentucky, College of Agriculture. [retrieved on Jul. 15, 2002]. Retrieved from the Internet: <URL:http://www.ca.uky.edu/agc/pubs/asc/asc140/asc140.htm>; 22 pgs.

Crosa, "The Relationship of Plasmid-Mediated Iron Transport and Bacterial Virulence," *Annu. Rev. Microbiol.*, 1984;38:69-89.

Crosa, "Genetics and Molecular Biology of Siderophore-Mediated Iron Transport in Bacteria," *Microbiol. Rev.*, Dec. 1989; 53(4):517-530.

Curtiss, III et al., "Live oral avirulent *Salmonella* Vaccines," *Vet. Microbiol.*, Nov. 1993;37(3-4):397-405.

Danve et al., "Transferrin-binding proteins isolated from *Neisseria meningitidis* elicit protective and bactericidal antibodies in laboratory animals," *Vaccine*. Sep. 1993; 11(12):1214-1220.

Davies et al., "Characterisation of bovine strains of *Pasteurella multocida* and comparison with isolates of avian, ovine and porcine origin," *Vet. Microbiology*, 2004, 99:145-158.

Davison et al., "Field Observations with *Salmonella enteritidis* Bacterins," *Avian Dis.*, Oct.-Dec. 1999;43(4):664-669.

Dziaba et al., "An attempt to immunize pigs against colibacteriosis under field conditions," *Medycyna Weterynaryjna*, 1984;40(8):455-457 (English language abstract on p. 457).

El-Shobaki et al., "Mucosal Transferrin and Ferritin Factors in the Regulation of Iron Absorption," *Res. Exp. Med. (Berl).*, Dec. 15, 1977;171(3):243-253.

Erdei et al., "Lactoferrin Binds to Porins OmpF and OmpC in *Escherichia coli*," *Infect. Immun.*, Apr. 1994;62(4):1236-1240.

E-Toxate® (Technical Bulletin No. 210). SIGMA Chemical Company, St. Louis, MO, 1998. pp. 1-4.

Feng et al., "P55, an Immunogenic but Nonprotective 55-Kilodalton *Borrelia burgdorferi* Protein in Murine Lyme Disease," *Infect. Immun.*, Jan. 1996;64(1):363-365.

Ferguson et al., "Siderophore-Mediated Iron Transport: Crystal Structure of FhuA with Bound Lipopolysaccharide," *Science*, Dec. 18, 1998;282(5397):2215-2220.

Filip et al., "Solubilization of the Cytoplasmic Membrane of *Escherichia coli* by the Ionic Detergent Sodium-Lauryl Sarcosinate," *J. Bacteriol.*, Sep. 1973;115(3):717-722.

Finkelstein et al., "Role of Iron in Microbe-Host Interactions," *Rev. Infect. Dis.*, Sep.-Oct. 1983;5 Suppl 4: S759-776.

Francis et al., "Immunological Priming with Synthetic Peptides of Foot-and-Mouth Disease Virus," *J. Gen. Virol.*, Nov. 1985;66(Pt 11):2347-2354.

Fukutome et al., "Intestinal mucosal immune response in chickens following intraocular immunization with liposome-associated *Salmonella enterica* serovar *enteritidis* antigen," *Dev. Comp. Immunol.*, Jun.-Jul. 2001;25(5-6):475-484.

Furugouri, "Iron Binding Substances in the Intestinal Mucosa of Neonatal Piglets," *J Nutr.* Mar. 1977;107(3):487-494.

Gast et al., "Deposition of Phage Type 4 and 13a *Salmonella enteritidis* Strains in the Yolk and Albumen of Eggs Laid by Experimentally Infected Hens," *Avian Dis.*, Jul.-Sep. 2000;44(3):706-710.

Germanier et al., "Isolation and Characterization of *Gal* E Mutant Ty 21a of *Salmonella typhi*: A Candidate Strain for a Live, Oral Typhoid Vaccine," *J. Infect. Dis.*, May 1975;131(5):553-558.

Gilleland, Jr. et al., "Use of a Purified Outer Membrane Protein F (Porin) Preparation of *Pseudomonas aeruginosa* as a Protective Vaccine in Mice," *Infect. Immun.*, Apr. 1984;44(1):49-54.

Gilleland, Jr. et al., "Perspectives on the Potential for Successful Development of Outer Membrane Protein Vaccines," *Eur. J. Clin. Microbiol.*, Jun. 1987;6(3):231-233.

Gilmour et al., "Vaccine containing iron-regulated proteins of *Pasteurella haemolytica* A2 enhances protection against experimental pasteurellosis in lambs," *Vaccine*, Feb. 1991;9(2):137-140.

Glisson et al., "In Vivo Antigen Expression by *Pasteurella multocida*," *Avian Dis.*, Apr.-Jun. 1991;35(2):392-396.

Glisson et al., "Cross-Protection Studies with *Pasteurella multocida* Bacterins Prepared from Bacteria Propagated in Iron-Depleted Medium," *Avian Dis.*, Oct.-Dec. 1993;37(4):1074-1079.

Goding, "*Monoclonal Antibodies: Principles and Practice*," Academic Press, San Diego, CA, 1986, 162-165.

Griffiths et al., "Naturally Occurring Antibodies in Human Sera that React with the Iron-Regulated Outer Membrane Proteins of *Escherichia coli*," *Infect. Immun.*, Mar. 1985;47(3):808-813.

Griffiths et al., "Pathogenic *Escherichia coli* express new outer membrane proteins when growing in vivo," *FEMS Microbiology Letters*, Jan. 1983;16(1):95-99.

Gruet et al., "Bovine mastits and intramammary drug delivery: review and perspectives," *Advanced Drug Delivery Reviews*, 2001, 50:245-259.

Haddadi et al., "*E. coli* proteolytic activity in milk and casein breakdown," *Reprod. Nutr. Dev.*, 2005, 45:485-496 (abstract only).

Hancock et al., "Iron Transport in *Escherichia coli* K-12: Involvement of the Colicin B Receptor and of a Citrate-Inducible Protein," *J. of Bacteriol.*, Sep. 1976;127(3):1370-1375.

Harlow et al., Antibodies, A Laboratory Manual, generally and Chapter 5, Cold Spring Harbor Laboratory, Cold Spring Harbor, New York, NY (1988).

Hassan et al., "Development and Evaluation of an Experimental Vaccination Program Using a Live Avirulent *Salmonella typhimurium* Strain to Protect Immunized Chickens Against Challenge with Homologous and Heterologous *Salmonella* Serotypes," *Infect. Immun.*, Dec. 1994;62(12):5519-5527.

Heinrichs et al., "Identification and Characterization of SirA, an Iron-Regulated Protein from *Staphylococcus aureus*," *J. Bacteriol.*, Mar. 1999;181(5):1436-1443.

Helenius et al., "Solubilization of Membranes by Detergents," *Biochim. Biophys. Acta.*, Mar. 25, 1975;415(1):29-79.

Hirst et al., "Iron-regulated outer membrane proteins of *Aeromonas salmonicida* are important protective antigens in Atlantic salmon against furunculosis," *Fish & Shellfish Immunology*, Jan. 1994;4(1):29-45.

Hjelmeland, "Solubilization of Native Membrane Proteins," *Methods Enzymol.*, 1990;182:253-264.

Hohmann et al., "*phoP/phoQ-Deleted Salmonella typhi* (Ty800) is a Safe and Immunogenic Single-Dose Typhoid Fever Vaccine in Volunteers," *J. Infect. Dis.*, Jun. 1996;173(6):1408-1414.

Hope et al., "An Overview of the *Salmonella* Enteritidis Risk Assessment for Shell Eggs and Egg Products," *Risk Anal.*, Apr. 2002;22(2):203-218.

House et al., "Evaluation of an autogenous *Salmonella* bacterin and a modified live *Salmonella* serotype *Choleraesuis* vaccine on a commercial dairy farm," *Am. J. Vet. Res.*, Dec. 2001;62(12):1897-1902.

Hudson et al., "Lymphokines and Cytokines," In: *Practical Immunology*, 3rd Edition, Blackwell Scientific Publications, London, UK, 1989, 423-441.

Humphrey et al., "Contamination of egg shell and contents with *Salmonella enteritidis*: a review," *Int. J. Food Microbiol.*, Jan. 1994;21(1-2):31-40.

Hussain et al., "A Lithium Chloride-Extracted, Broad-Spectrum-Adhesive 42-Kilodalton Protein of *Staphylococcus epidermidis* is Ornithine Carbamoyltransferase," *Infect. Immun.*, Dec. 1999;67(12):6688-6690.

Ikeda et al., "Antigenically Related Iron-Regulated Outer Membrane Proteins Produced by Different Somatic Serotypes of *Pasteurella multocida*," *Infect. Immun.*, Sep. 1988;56(9):2499-2502.

Jiang et al., "Ligand-Specific Opening of a Gated-Porin Channel in the Outer Membrane of Living Bacteria," *Science*, May 1997, 276:1261-1264.

Johansen et al., "Prevention of Edema Disease in Pigs by Vaccination with Verotoxin 2e Toxoid," *Can. J. Vet. Res.*, 1997;61:280-285.

Jousimies et al., "Genetic Analysis of *Salmonella minnesota* R Mutants with Defects in the Biosynthesis of the *Lipopolysaccharide* Core," *J. Bacteriol.*, Sep. 1974;119(3):753-759.

Keler et al., "Metachromatic Assay for the Quantitative Determination of Bacterial Endotoxins," *Anal. Biochem.*, Jul. 1986;156(1):189-193.

Khan et al., "Reducing colonization of *Salmonella enteritidis* in chicken by targeting outer membrane proteins," *J. Appl. Microbiol.*, 2003;95(1):142-145.

Kizil et al., "Identification and Characterization of TspA, a Major $CD4^+$T-Cell- and B-Cell-Stimulating *Neisseria*-Specific Antigen," *Infect. Immun.*, Jul. 1999;67(7):3533-3541.

Klebba et al., "Kinetics of Biosynthesis of Iron-Regulated Membrane Proteins in *Escherichia coli*," *J. Bacteriol.*, Mar. 1982;149(3):880-888.

Koebnik et al., "Structure and function of bacterial outer membrane proteins: barrels in a nutshell," *Molecular Microbiology*, 2000, 37/2:239-253.

Köhler et al., "Continuous cultures of fused cells secreting antibody of predefined specificity," *Nature*, Aug. 7, 1975;256(5517):495-497.

Konadu et al., "Preparation, Characterization, and Immunological Properties in Mice of *Escherichia coli* O157 O-Specific Polysaccharide-Protein Conjugate Vaccines," *Infect. Immun.*, Nov. 1994;62(11):5048-5054.

Kotloff et al., "Safety, Immunogenicity, and Transmissibility in Humans of CVD 1203, a Live Oral *Shigella flexneri* 2a Vaccine Candidate Attenuated by Deletions in *aroA* and *virG*," *Infect. Immun.*, Nov. 1996;64(11):4542-4548.

Laemmli, "Cleavage of Structural Proteins during the Assembly of the Head of Bacteriophage T4," *Nature*, Aug. 15, 1970;227(5259):680-685.

Lainson et al., "Identification and localization of an iron-regulated 35 kDa protein of *Pasteurella haemolytica* serotype A2" *J. Gen. Microbio.*, Feb. 1991, vol. 137(2): 219-226.

Lalmanach et al., "Host cytokine response and resistance to *Salmonella* infection," *Microbes Infect.*, Jul. 1999;1(9):719-726.

Lee et al., "Elevated Milk Soluble CD14 in Bovine Mammary Glands Challenged with *Escherichia coli* Lipopolysaccharide," *J. Dairy Science*, 2003, 86:2382-2389.

Leitner et al., "Development of a *Staphylococcus aureus* vaccine against mastitis in dairy cows. II. Field Trial," *Veterinary Immunology and Immunopathology*, 2003;93:153-158.

Lindsay et al., "*Staphylococcus aureus* but not *Staphylococcus epidermidis* can acquire iron from transferrin," *Microbiology*, 1995;141:197-203.

Lindsay et al., "*Staphylococcal* Iron Requirements, Siderophore Production, and Iron-Regulated Protein Expression," *Infect. Immun.*, Jun. 1994;62(6):2309-2314.

Lu et al., "A Monoclonal Antibody against a *Pasteurella multocida* Outer Membrane Protein Protects Rabbits and Mice against Pasteurellosis," *Infect. Immun.*, Jan. 1991;59(1):172-180.

Lu et al., "The Outer Membrane of *Pasteurella multocida* 3:A Protects Rabbits against Homologous Challenge," *Infect. Immun.*, Dec. 1991;59(12):4517-4523.

Lübke et al., "Isolation and Partial Characterization of the Major Protein of the Outer Membrane of *Pasteurella haemolytica* and *Pasteurella multocida*,"*Zentralbl Bakteriol.*, Jun. 1994;281(1):45-54.

Lüderitz et al., "Lipopolysaccharides, the O antigens and endotoxins of Gram-negative bacteria: Relationships of chemical structure and biological activity," *The Virulence of Escherichia coli*, Sussman, ed., The Society for General Microbiology, Academic Press, 73-88 (1985).

Lumsden et al., "Resistance to fecal shedding of *Salmonellae* in pigs and chickens vaccinated with an aromatic-dependent mutant of *Salmonella typhimurium*," *Am. J. Vet. Res.*, Nov. 1991;52(11):1784-1787.

Mäkelä et al., "Participation of Lipopolysaccharide Genes in the Determination of the Enterobacterial Common Antigen: Analysis of R Mutants of *Salmonella minnesota*," *J. Bacteriol.*, Sep. 1974;119(3):760-764.

Maniatis et al., *Molecular cloning: A Laboratory Manual*, Cold Spring Harbor Lab., New York, 1982, Cover pg., Publication pg., and Table of Contents only (8 pgs.).

Manspeaker, "Metritis and Endometritis," [online]. *Northeast IRM Manual*. [retrieved on Jan. 25, 2005]. Retrieved from the Internet: <URL:http://www.wvu.edu/~exten/infores/pubs/livepoul/dirm22.pdf>. 4 pgs.

Matsui et al., "Specificity of Protective Immunity Induced by Porin from *Salmonella typhimurium*," *Microbiologica.*, 1991;14:103-112.

Matthews-Greer et al., "Outer Membrane Protein F (Porin) Preparation of *Pseudomonas aeruginosa* as a Protective Vaccine Against Heterologous Immunotype Strains in a Burned Mouse Model," *J. Infect. Dis.*, Jun. 1987;155(6):1282-1291.

Mazurier et al.,"Visualization of lactotransferrin brush-border receptors by ligand-blotting," *Biochim. Biophys. Acta.*, Dec. 19, 1985;821(3):453-460.

Mead et al., "Food-Related Illness and Death in the United States," *Emerg. Infect. Dis.*, Sep.-Oct. 1999;5(5):607-625.

Medearis, Jr. et al., "Cell Wall Composition and Virulence in *Escherichia coli*," *J. Exp. Med.*, Sep. 1, 1968;128(3):399-414.

Meenakshi et al., "Adjuvanted Outer Membrane Protein Vaccine Protects Poultry Against Infection with *Salmonella enteritidis*," *Vet. Res. Commun.*, Mar. 1999;23(2):81-90.

Merrifield, "Solid Phase Peptide Synthesis. I. The Synthesis of a Tetrapeptide," *J. Am. Chem. Soc.*, Jul. 20, 1963;85(14):2149-2154.

Modun et al., "The *Staphylococcus aureus* and *Staphylococcus epidermidis* transferrin-binding proteins are expressed in vivo during infection," *Microbiology*, 1998;144:1005-1012.

Murray et al., "Antigenic analysis of iron-regulated proteins in *Pasteurella haemolytica* A and T biotypes by immunoblotting reveals biotype-specific epitopes," *J. Gen. Microbiol.*, Feb. 1992;138(Pt 2):283-288.

Muthukkaruppan et al., "Monoclonal antibodies against *Salmonella* porins: generation and characterization," *Immunol. Lett.*, Jul. 1992;33(2):201-206.

Nagaraja, "Influence of environment and other infectious agents on *E. coli* infection," *Poultry Digest*, p. 150 (1984).

Naiki et al., "Regulatory Role of Peritoneal NK1.1$^+$ $\alpha\beta$ T Cells in IL-12 Production During *Salmonella* Infection," *J. Immunol.*, Aug. 15, 1999;163(4):2057-2063.

Nardelli-Haefliger et al., "Oral and Rectal Immunization of Adult Female Volunteers with a Recombinant Attenuated *Salmonella typhi* Vaccine Strain," *Infect. Immun.*, Dec. 1996;64(12):5219-5224.

Neilands, "Microbial Iron Compounds," *Ann. Rev. Biochem.*, 1981;50:715-731.

Neilands, "Microbial Envelope Proteins Related to Iron," *Ann. Rev. Microbiol.*, 1982;36:285-309.

Neugebauer, "Chapter 18: Detergents: An Overview," *Methods in Enzymology: Guide to Protein Purification*, Deutscher, Ed., Academic Press, San Diego, CA, 1990;182:Cover pg., Publication pg., and 239-253.

Nikaido et al., "Chapter 3: Outer Membrane," *Escherichia coli* and *Salmonella typhimurium: Cellular and Molecular Biology*, Neidhardt et al., eds., American Society for Microbiology, Washington, D.C., pp. 7-22 (1987).

Nilius et al., "Identification of extracellular siderophores of pathogenic strains of *Aspergillus fumigatus*," *J. Med. Vet. Mycol.*, 1990;28(5):395-403.

Ochoa-Repàraz et al., "Humoral immune response in hens naturally infected with *Salmonella enteritidis* against outer membrane proteins and other surface structural antigens," *Vet. Res.*, May-Jun. 2004;35(3):291-298.

Ogawa et al., "Immunochemical and Biological Characterization of Outer Membrane Proteins of *Porphyromonas endodontalis*," *Infect. Immun.*, Nov. 1992;60(11):4528-4533.

Ogunnariwo et al., "Evidence for non-siderophore-mediated acquisition of transferrin-bound iron by *Pasteurella multocida*," *Microb Pathog.*, Jul. 1991;11(1):47-56.

Ogunnariwo et al., "Correlation between the Ability of *Haemophilus paragallinarum* to Acquire Ovotransferrin-Bound Iron and the Expression of Ovotransferrin-Specific Receptors," *Avian Dis.*, Jul.-Sep. 1992;36(3):655-663.

Okamura et al., "Differences Among Six *Salmonella* Serovars in Abilities to Colonize Reproductive Organs and to Contaminate Eggs in Laying Hens," *Avian Dis.*, Jan.-Mar. 2001;45(1):61-69.

Okamura et al., "Differences in Abilities to Colonize Reproductive Organs and to Contaminate Eggs in Intravaginally Inoculated Hens and In Vitro Adherences to Vaginal Explants Between *Salmonella enteritidis* and Other *Salmonella* Serovars," *Avian Dis.*, Oct.-Dec. 2001;45(4):962-971.

Okamura et al., "Cell-mediated immune responses to a killed *Salmonella enteritidis* vaccine: lymphocyte proliferation, T-cell changes and interleukin-6 (IL-6), IL-1, IL-2, and IFN-γ production," *Comp. Immunol. Microbiol. Infect. Dis.*, Jul. 2004;27(4):255-272.

Osborn et al., "Proteins of the Outer Membrane of Gram-Negative Bacteria," *Annu. Rev. Microbiol.*, 1980;34:369-422.

Overbeek et al., "Carumonam Enhances Reactivity of *Escherichia coli* with Mono- and Polyclonal Antisera to Rough Mutant *Escherichia coli* J5," *J. Clin. Microbiol.*, Jun. 1987;25(6):1009-1013.

Perkins et al., "Probability-based protein identification by searching sequence databases using mass spectrometry data," *Electrophoresis*, Dec. 1999;20(18):3551-3567.

Porter et al., "*Escherichia coli* Antigens as Dietary Additives for Oral Immunisation of Pigs: Trials with Pig Creep Feeds," *Vet. Rec.*, Jun. 16, 1973;92(24):630-636.

Rae, "Injection Site Reactions," [online]. University of Florida, Department of Animal Sciences, [retrieved on Oct. 16, 2003]. Retrieved from the Internet: <URL:http://www.animal.ufl.edu/extension/beef/documents/short94/rae.htm>. 3 pgs.

Rimler, "Cross-Protection Factor(s) of *Pasteurella multocida*: Passive Immunization of Turkeys Against Fowl Cholera Caused by Different Serotypes," *Avian Dis.*, Oct.-Dec. 1987;31(4);884-887.

Rimler et al, "Solubilization of Membrane-Associated Cross-Protection Factor(s) of *Pasteurella multocida*," *Avian Dis.*, Apr.-Jun. 1989;33(2):258-263.

Rimler, "Partial Purification of Cross-Protection Factor(s) from *Pasteurella multocida*," *Avian Dis.*, Oct.-Dec. 1994;38(4):778-789.

Robledo et al., "Outer Membrane Proteins of *E. coli* in the Host-Pathogen Interaction in Urinary Tract Infection," *J. Urol.*, Feb. 1990;143(2):386-391.

Roof et al., "Safety, efficacy, and duration of immunity induced in swine by use of an avirulent live *Salmonella choleraesuis*-containing vaccine," *Am. J. Vet. Res.*, Jan. 1995;56(1):39-44.

Sack et al., "Validation of a Volunteer Model of Cholera with Frozen Bacteria as the Challenge," *Infect. Immun.*, May 1998;66(5):1968-1972.

Sanchez et al, "Cholera," *Lancet*, Jun. 21, 1997;349(9068):1825-1830.

Sansonetti et al., "*Shigellosis*: from molecular pathogenesis of infection to protective immunity and vaccine development," *Res. Immunol.*, Oct.-Dec. 1996;147(8-9):595-602.

Snipes et al., "Plasma- and iron-regulated expression of high molecular weight outer membrane proteins by *Pasteurella multocida*," *Am. J. Vet. Res.*, Aug. 1988;49(8):1336-1338.

Stewart et al., *Solid Phase Peptide Synthesis*, $2^{nd}$ Edition, Pierce Chemical Co., Rockford IL, 1984; Cover page, Publication page, and Table of Contents only (7 pgs.).

Stocker, "Auxotrophic *Salmonella typhi* as live vaccine," *Vaccine*, Apr. 1988;6(2):141-145.

Stuart et al., "Iron-Suppressible Production of Hydroxamate by *Escherichia coli* Isolates," *Infect. Immun.*, Jun. 1982;36(3):870-875.

Szu et al., "Laboratory and Preliminary Clinical Characterization of Vi Capsular Polysaccharide-Protein Conjugate Vaccines," *Infect. Immun.*, Oct. 1994;62(10):4440-4444.

Tabaraie et al., "Evaluation of *Salmonella* Porins as a Broad Spectrum Vaccine Candidate," *Microbiol. Immunol.*, 1994;38(7):553-559.

Tacket et al., "Comparison of the Safety and Immunogenicity of ΔaroC ΔaroD and Δcya Δcrp *Salmonella typhi* Strains in Adult Volunteers," *Infect. Immun.*, Feb. 1992;60(2):536-541.

Tacket et al., "Clinical acceptability and immunogenicity of CVD 908 *Salmonella typhi* vaccine strain," *Vaccine*, 1992;10(7):443-446.

Tatusova et al., "BLAST 2 Sequences, a new tool for comparing protein and nucleotide sequences," *FEMS Microbiol Lett.*; May 15, 1999;174(2):247-250.

Taylor et al., "Evaluation of a Bivalent (CVD 103-HgR/CVD 111) Live Oral Cholera Vaccine in Adult Volunteers from the United States and Peru," *Infect. Immun.*, Sep. 1997;65(9):3852-3856.

Title 9: Animals and Animal Products, *9 CFR 113.120, 122, 123*, undated, (2 pgs.).

Tokunaga et al., "Characterization of Porins from the Outer Membrane of *Salmonella typhimurium*," *Eur. J. Biochem.*, 1979, 95:433-439.

Todhunter et al., "Antibodies to iron-regulated outer membrane proteins of coliform bacteria isolated from bovine intramammary infections," *Vet. Immunol. Immunopath.*, 1991;28:107-115.

Trach et al., "Field trial of a locally produced, killed, oral cholera vaccine in Vietnam," *Lancet*, Jan. 25, 1997;349(9047):231-235.

Trivier et al., "Influence of iron depletion on growth kinetics, siderophore production, and protein expression of *Staphylococcus aureus*," *FEMS Microbiol. Lett.*, 1995;127:195-200.

Truscott et al., "Demonstration of an Outer Membrane Protein with Antiphagocytic Activity from *Pasteurella multocida* of Avian Origin," *Infect. Immun.*, Jun. 1988;56(6):1538-1544.

Tufano et al., "Properties of *Yersinia enterocolitica* porins: interference with biological functions of phagocytes, nitric oxide production and selective cytokine release," *Res. Microbiol.*, May 1994;145(4):297-307.

van der Helm, "Physical Biochemistry of FEPA and other Siderophore Receptor Proteins," *J. Inorg. Biochem.*, 1995;59(2-3):90 (abstract only).

Vasfi Marandi et al., "The 32 kDa major outer-membrane protein of *Pasteurella multocida* capsular serotype D," *Microbiology*, Jan. 1996;142(Pt 1):199-206.

Villarreal-Ramos et al., "Immune responses in calves immunised orally or subcutaneously with a live *Salmonella typhimurium* aro vaccine," *Vaccine*, Jan. 1998;16(1):45-54.

Visca et al., "Siderophore production by *Salmonella* species from different sources," *FEMS Microbiol. Lett.*, Apr. 15, 1991;79(2-3):225-231.

Watson et al., eds., "Endotoxins and Their Detection With the Limulus Amebocyte Lysate Test," (Progress in Clinical and Biological Research; v. 93), *Proceedings of an International Conference on Endotoxin Standards and Limulus Amebocyte Lysate Use With Parenteral Drugs, Held at the Woods Hole Oceanographic Institution*, Woods Hole, MA, Sep. 1981, Alan R. Liss, Inc., 150 Fifth Avenue, New York, NY (1982), title pages, publication page, and table of contents only (5 pages).

Wells et al., "What is the Current Milk Quality in the U.S.?" [online]. National Mastitis Council, [retrieved on Aug. 29, 2000]. Retrieved from the Internet: <URL:http://www.nmconline.org/articles/USQuality.htm>. 7 pgs.

Wellenberg et al., "Simultaneous intramammary and intranasal inoculation of lactating cows with bovine herpesvirus 4 induce subclinical mastitis," *Vet. Microbiol.*, 2002, 86:115-129.

Williams et al., "Novel Aerobactin Receptor in *Klebsiella pneumoniae*," *J. Gen. Microbiol.*, 1989;135:3173-3181.

Yokoyama et al., "Effect of Oral Egg Antibody in Experimental F18+ *Escherichia coli* Infection in Weaned Pigs," *J. Vet. Med. Sci.*, Oct. 1997;59(10): 917-921.

Zhang et al., "Molecular Pathogenesis of *Salmonella enterica* Serotype Typhimurium-Induced Diarrhea," *Infect. Immun.*, Jan. 2003;71(1):1-12.

Zhao et al., "Expression of Iron-Regulated Outer Membrane Proteins by Porcine Strains of *Pasteurella multocida*," *Can. J. Vet. Res.*, 1995;59(1):46-50.

Arnoud et al., "Iron-Responsive Gene Regulation in a *Campylobacter jejuni fur* Mutant" *Journal of Bacteriology*, Oct. 1998; 180(20):5291-5298.

Blaser et al., "*Campylobacter jejuni* Outer Membrane Proteins are Antigenic for Humans" *Infection and Immunity*, Mar. 1984; 43(3):986-993.

Holmes et al., "*Campylobacter jejuni* Gene Expression in Response to Iron Limitation and the Role of Fur" *Microbiology*, 2005; 151:243-257.

Palyada et al., "Iron Acquisition and Regulation in *Campylobacter jejuni*" *Journal of Bacteriology*, Jul. 2004; 186(14):4714-4729.

Schierack et al., "Composition of intestinal *Enterobacteriaceae* populations of healthy domestic pigs" Microbiology, 2007; 153:3830-3837.

Bock et al., "Whole-proteome interaction mining," *Bioinformatics*, Jan. 2003;19(1):125-134.

Bos et al., "Biogenesis of the gram-negative bacterial outer membrane" *Current Opinion in Microbiology*, 2004; 7:610-616.

Liebler, "Protein Identification by Peptide Mass Fingerprinting," Chapter 7 in *Introduction to Proteomics: Tools for the New Biology*, Humana Press, Totowa, NJ, 2002; title page, copyright page and pp. 77-87, total 8 gps.

Petsch et al., "Endotoxin removal from protein solutions," *Journal of Biotechnology*, 76: 97-119 (2000).

U.S. Appl. No. 12/101,802, filed Apr. 11, 2008, Emery et al.

U.S. Appl. No. 12/269,636, filed Nov. 12, 2008, Emery et al.

U.S. Appl. No. 12/347,332, filed Dec. 31, 2008, Emery et al.

U.S. Appl. No. 12/393,275, filed Feb. 26, 2009, Emery et al.

Abimiku et al., "Comparison of different vaccines and induced immune response against *Campylobacter jejuni* colonization in the infant mouse," *Epidem. Inf.*, 1989;102:271-280.

Miyaji et al., "Analysis of Serum Cross-Reactivity and Cross-Protection Elicited by Immunication wtih DNA Vaccines against *Streptococcus pneumoniae* Expressing PspA Fragments from Different Clades," *Infection and Immunity*, Sep. 2002;70(9):5086-5090.

Baillon, et al., "An Iron-Regulated Alkyl Hydroperoxide Reductase (AhpC) Confers Aerotolerance and Oxidative Stress Resistance to the Microaerophilic Pathogen *Campylobacter jejuni*", *Journal of Bacteriology*, Aug. 1999;181(16):4798-4803.

* cited by examiner

Figure 12

```
  1 mnkkihsltl lvnlgiygaa lpvmaeektd saaltnedti vvtaaqqnlq apgvstitad
 61 eirknppard vseiirtmpg vnltgnstsg qrgnnrqidi rgmgpentli lidgkpvtsr
121 nsvrlgwrge rdtrgdtawv ppemieriev lrgpaaaryg ngaaggvvni itkkggsewh
181 gswntyfnap ehkdegatkr tnfslngplg gdfsfrlygn ldktqadarn inqghqsert
241 gsyadtlpag regvinkdin gvvrwdfapl qsleleagys rqgnlyagdt qntntnqlvk
301 dnygketnrl yrqnysltwn ggwdngvtts nwvqyehtrn srmpeglagg tegifdpkas
361 qkyadadlnd vtlhsevslp fdllvnqnlt lgtewaqqrm kdqlsnsqtf mggnipgyss
421 tnrspyskae ifslfaennm eltdstmltp girfdhhsiv gdnwspslnl sqglgddftl
481 kmgiarayka pslyqtnpny ilyskgqgcy atgagtgigc ymmgnddlka etsinkeigl
541 efkrdgwlag vtwfrndyrn kieagtvplq rinngktdvy qwenvpkavv eglegtlnvp
601 vsdtvnwtnn vtymlqsknk etgerlsiip qytlnstlsw qvrqdvslqs tftwygkqep
661 kkydyqgnpv tgtdkqavsp ysivglsatw dvtknvsltg gvdnlfdkrl wregnaqtvr
721 dtqtgaymag agaytynepg rtwymsinth f
```

Figure 13

```
  1 mgmkvnkflw litvvstgvn splsaaestd dngetmvves taeqvlkqqp gvsiitrddi
 61 qknppvndla diirkmpgvn ltgnsasgtr gnnrqidirg mgpentlvli dgvpvtsrns
121 vryswrgerd trgdtnwpp emverievir gpaaarygsg aaggvvniit krptndwhgs
181 lslytnqpes skegdtrrgn fslsgplagd tltmrlygnl nrtdadswdi nssagtknaa
241 gregvtnkdi nsvfswrmtp qqildfeagy srqgniyagd tqnststnavt kslaqsgret
301 nrlyrqnygl thngiwdwgq srlgfyyekt dntrmnegls gggegritnd qtfttnrlts
361 yrtsgevnvp viwlfeqtlt vgaewnrdel ndpsstsltv kdsniagipg saanrssknk
421 seisalyved niepmagtni ipglrfdyls esgsnfspsl nlsqelgeyv kvkagiaraf
481 kapnlyqtse gyllyskgng cpkditsggc ylvgnknldp eisinkeigl eftvddyhas
541 vtyfrndyqn kivagdqiig rsasgayvlq wqnggkalie gieasmavpl mpdrlnwntn
601 atymitseqk dtgnplsiip kytvntfldw titsalsanv nwtlygkqkp rthaesrsee
661 tkglsgkalg ayslvganvn ydinknlrln vgisnifdkq iyrsaegant ynepgrayya
721 gvtasf
```

Figure 14

```
  1 mfrfnpfvrv glcmsavtla wpvaaatddg etmvvtasai eqnlkdapas isvitqqdlq
 61 rrpvqnlkdv lkevpgvqlt negdnrkgvs irgldssytl ilidgkrvns rnavfrhndf
121 dlnwipvdai erievvrgpm sslygsdalg gvvniitkki gqkwhgsvtv dstiqehrdr
181 gdtyngqfft sgplidgvlg mkaygslakr ekdeqqssat tatgetprie gftsrdgnve
241 fawtpnenhd vtagygfdrq drdsdsldkn rlerqnyals hngrwdlgns elkfygekve
301 nknpgnsspi tsesnsidgk yvlplasvnq fltfggewrh dklsdavslt ggsstktsas
361 qyalfledew rifeplaltt girmddhety gdhwsprayl vynatdtltv kggwatafka
421 psllqlspdw atnscrggcr ivgspdlkpe tseswelgly yrgeegileg veasvttfrn
481 dvdnrisisr tpdvnaapgy snfvgfetns rgqrvpvfry ynvnkariqg vetelkvpfn
541 eawklslnyt yndgrdvsng gnkplsdlpf htangtldwk paqledwsfy vsgnytgrkr
601 adsataktpg gyvvwdtgaa wqatknvklr agvlnvgdkd lkrddygyte dgrryfmavd
661 yrf
```

Figure 15

```
  1 mikkatllta fsvtafsawa qdtspdtlvv tanrfqqprs avlapvtivt rqdierwqst
 61 svndvlrrlp gvdiaqsgga gqnssifirg tnsshvlvli dgvrlnlagv sgsadlsqfp
121 vslvqrieyi rgprsaiygs daiggvvnii ttrdnpgtel tagwgsnsyq nydistqqql
181 gentratlig dyeytkgfdv vakggtgmqa qpdrdgflsk tlygalehtf sdrwsgfvrg
241 ygydnrtdyd ayyspgspli dtrklysqsw daglhfnger iqsqlvssys hskdynydph
301 ygrydtsatl demkqynvqw tnsvvvghgn vgagvdwqkq tttpgtgyvp egydqrntgv
361 yltglqqlgd ftleaaarsd dnsqfgrhgt wqtsagwefi egyrfiasyg tsykapnlgq
421 lygyygnpnl npekskqweg afegltagvs wrisgyrndi ndmidyddhl qkyynegkar
481 ikgieatanf dtgplthtvs ydyvdarnai tdtplprrsk qmakyqldwd vydfdwgmty
541 qylgsrydsd ysaypyrtvk mggvslwdlt vaypvtshlt vrgkianlfd kdyetvygyq
601 tagreytlsg sytf
```

Figure 16

```
  1 maqvintnsl slltqnnlnk sqsalgtaie rlssglrins akddaagqai anrftanikg
 61 ltqasrnand gisiaqtteg alneinnnlq rvrelavqsa nstnsqsdld siqaeitqrl
121 neidrvsgqt qfngvkvlaq dntltiqvga ndgetididl kqinsqtlgl dslnvqkayd
181 vkdtavttka yanngttldv sglddaaika atggtngtas vtggavkfda dnnkyfvtig
241 gftgadaakn gdyevnvatd gtvtlaagat kttmpagatt ktevqelkdt pavvsadakn
301 aliaggvdat dangaelvkm sytdkngkti eggyalkagd kyyaadydea tgaikaktts
361 ytaadgttkt aanqlggvdg ktevvtidgk tynaskaagh dfkaqpelae aaakttenpl
421 qkidaalaqv dalrsdlgav qnrfnsaitn lgntvnnlse arsriedsdy atevsnmsra
481 qilqqagtsv laqanqvpqn vlsllr
```

Figure 17

```
  1 maqvintnsl slltqnnlnk sqsalgtaie rlssglrins akddaagqai anrftanikg
 61 ltqasrnand gisiaqtteg alneinnnlq rvrelavqsa nstnsqsdld siqaeitqrl
121 neidrvsgqt qfngvkvlaq dntltiqvga ndgetididl kqinsqtlgl dtlnvqkkyd
181 vdstgvtqsl dlktagitga tlkagitgtt tetgsvkdgk vyydadskny yvevdftdtt
241 dkaahagfyk advdadgnvs latgatkeak ptnavevekt idekplkass svqdalkasg
301 iadavaeaat vvkmsytdkn gktidggygi kvgddyyaat kekdgsysin stsytdkdgn
361 tktalnqlgg adgktevvsi dgktynaska aghnfkaqpd laeaaattte nplqkidaal
421 aqvdalrsdl gavqnrfnsa itnlgntvnn lssarsried sdyatevsnm sraqilqqag
481 tsvlarv
```

Figure 18

```
  1 mqmkkllpil iglslsgfst lsqaenlmqv yqqarlsnpe lrksaadrda afekinears
 61 pllpqlglga dytysngyrd anginsnets aslqltqtlf dmskwrgltl qekaagiqdv
121 tyqtdqqtli lntanayfkv lnaidvlsyt qaqkeaiyrq ldqttqrfnv glvaitdvqn
181 araqydtvla nevtarnnld naveelrqvt gnyypelasl nvehfktdkp kavnallkea
241 enrnlsllqa rlsqdlareq irqaqdghlp tlnltastgi sdtsysgskt nsaqyddsnm
301 gqnkiglnfs lplyqggmvn sqvkqaqynf vgaseqlesa hrsvvqtvrs sfnninasis
361 sinaykqavv saqssldame agysvgtrti vdvldatttl ydakqqlana rytylinqln
421 ikyalgtlne qdllalnstl gkpiptspes vapetpeqda aadgynahsa apavqptaar
481 ansnngnpfr h
```

Figure 19

```
  1 vdfhgyarsg igwtgsggeq qcfqatgaqs kyrlgnecet yaelklgqev wkegdksfyf
 61 dtnvaysvnq qndwestdpa freanvqgkn liewlpgsti wagkrfyqrh dvhmidfyyw
121 disgpgagie nidlgfgkls laatrsteag gsytfssqni ydevkdtand vfdvrlaglq
181 tnpdgvlelg vdygranttd gykladgask dgwmftaeht qsmlkgynkf vvqyatdamt
241 tqgkgqargs dgsssfteel sdgtkinyan kvinnngnmw rildhgaisl gdkwdlmyvg
301 myqnidwdnn lgtewwtvgv rpmykwtpim stllevgydn vksqqtgdrn nqykitlaqq
361 wqagdsiwsr pairifatya kwdekwgyik dgdnisryaa atnsgistns rgdsdewtfg
421 aqmeiww
```

Figure 20

```
  1 mklklvavav tsllaagvvn aaevynkdgn kldlygkvha qhyfsddngs dgdktyarlg
 61 fkgetqindq ltgfgqweye fkgnrtesqg adkdktrlaf aglkfadygs fdygrnygva
121 ydigawtdvl pefggdtwtq tdvfmtgrtt gvatyrntdf fglveglnfa aqyqgkndrd
181 gayesngdgf glsatyeyeg fgvgaayaks drtnnqvkaa snlnaagkna evwaaglkyd
241 anniylatty setlnmttfg edaagdafia nktqnfeava qyqfdfglrp siaylkskgk
301 nlgtygdqdl veyidvgaty yfnknmstfv dykinlldds dftkaakvst dnivavglny
361 qf
```

Figure 21

```
  1 mkvkvlsllv pallvagaan aaeiynkdgn kldlfgkvdg lnyfsddkgs dgdqtymrig
 61 fkgetqvndq ltgygqweyq iqgnqtegsn dswtrvafag lkfadagsfd ygrnygvtyd
121 vtswtdvlpe fggdtygadn fmqqrgngya tyrntdffgl vdgldfalqy qgkngsvsge
181 ntngrsllnq ngdgyggslt yaigegfsvg gaittskrta dqdntanarl ygngdratvy
241 tgglkydann iyvaaqyfqt ynatrfgtsn gsnpstsygf ankaqnfevv aqyqfdfglr
301 psvaylqskg kdisngygas ygdqdivkyv dvgatyyfnt nmstyvdyki nlldkyeftr
361 dagintddiv alglvyqf
```

Figure 22

```
  1 mkktaiaiav alagfatvaq aapkdntwya gaklgwsqyh dtgfihndgp thenqlgaga
 61 fggyqvnpyv gfemgydwlg rmpykgdntn gaykaqgvql taklgypitd dldvytrlgg
121 mvwradtksn vpggastkdh dtgvspvfag gieyaitpei atrleyqwtn nigdantigt
181 rpdngllsvg vsyrfgqqea apvvapapap apevqtkhft lksdvlfnfn kstlkpeggq
241 aldqlysqls nldpkdgsvv vlgftdrigs daynqglsek raqsvvdyli skgipsdkis
301 argmgesnpv tgntcdnvkp raalidclap drrveievkg vkdvvtqpqa
```

Figure 23

```
  1 fmragpatvr ptegaggtlg hlngfdvsnn tqlgltftym atdnigvell aatpfrhkvg
 61 tgatgdiatv hllpptlmaq wyfgdssskv rpyvgvgvny ttffdndfnd ngknaglsdl
121 sfkdswgaag qvgvdylinr dwligasvwy mdidttanyk mggvqhhdsv rldpwvfmfs
181 agyrf
```

Figure 24

```
  1 mkkiaclsal aavlafsagt avaatstvtg gyaqsdaqgv ankmsgfnlk yryeqddnpl
 61 gvigsftyte kdrtngagdy nkgqyygita gpayrlndwa siygvvgvgy gkfqttdypt
121 ykhdtsdygf sygaglqfnp menvaldfsy eqsrirsvdv gtwiagvgyr f
```

Figure 25

```
  1 mnrtklvlga vilgstllag cssnakidql ssdvqtlnak vdqlsndvna mrsdvqaakd
 61 daaranqrld nqatkyrk
```

Figure 26

```
  1 mkkriptlla tmiasalysh qglaadlasq cmlgvpsydr plvkgdtndl pvtinadnak
 61 gnypddavft gnvdimqgns rlqadevqlh qkqaegqpep vrtvdalgnv hyddnqvilk
121 gpkgwanlnt kdtnvwegdy qmvgrqgrgk adlmkqrgen rytilengsf tsclpgsdtw
181 svvgsevihd reeqvaeiwn arfkvgpvpi fyspylqlpv gdkrrsgfli pnakyttkny
241 fefylpyywn iapnmdatit phymhrrgni mwenefrylt qagegvmeld ylpsdkvyed
301 dhpkegdkhr wlfywqhsgv mdqvwrfnvd ytkvsdssyf ndfdskygss tdgyatqkfs
361 vgyavqnfda tvstkqfqvf ndqntssysa epqldvnyyh ndlgpfdtri ygqavhfvnt
421 kdnmpeatrv hleptinlpl snrwgslnte aklmathyqq tnldsynsdp nnknkledsv
481 nrvmpqfkvd gkliferdma mlapgytqtl eprvqylyvp yrdqsgiyny dssllqsdyn
541 glfrdrtygg ldriasanqv ttgvttriyd daaverfnvs vgqiyyftes rtgddnikwe
601 nddktgslvw agdtywrise rwglrsgvqy dtrldsvats sssleyrrdq drlvqlnyry
661 aspeyiqatl psyystaeqy knginqvgav aswpiadrws ivgayyfdtn sskpadqmlg
721 lqynsccyai rvgyerklng wdndkqhaiy dnaigfniel rglssnyglg tqemlrsnil
781 pyqssm
```

Figure 27

```
  1 mnkkihsltl lvnlgiygat lpvmaedktd saaltnedti vvtaaqqnlq apgvstitad
 61 eirknppard vseiirtmpg vnltgnstsg qrgnnrqidi rgmgpentli lidgkpvtsr
121 nsvrlgwrge rdtrgdtawv ppemieriev lrgpaaaryg ngaaggvvni itkkggsewh
181 gswntyfnap ehkdegatkr tnfslngplg gdfsfrlygn ldktqadarn inqghqsert
241 gsyadtlpag regvinkdin gvvrwdfapl qsleleagys rqgnlyagdt qntntnqlvk
301 dnygketnrl yrqnysltwn ggwnngvtts nwvqyehtrn srmpeglagg tegifdpkas
361 qkyadadlnd vtlhsevslp fdllvnqnlt lgtewaqqrm kdqlsnsqtf mggnipgyss
421 tnrspyskae ifslfaennm eltdstmltp glrfdhhsiv gdnwspslnl sqglgddftl
481 kmgiarayka pslyqtnpny ilyskgqgcy atgagtgigc ymmgnddlka etsinkeigl
541 efkrdgwlag vtwfrndyrn kieagtvplq rinngktdvy qwenvpkavv eglegtlnvp
601 vsdtvnwtnn vtymlqsknk etgerlsiip qytlnstlsw qvrqdvslqs tftwygkqep
661 kkydyqgnpv tgtdkqavsp ysivglsatw dvtknvsltg gvdnlfdkrl wregnaqtvr
721 dtqtgaymag agaytynepg rtwymsinth f
```

Figure 28

```
  1 mgmkvnkflw litvvstgvn splsaaestd dngetmvves taeqvlkqqp gvsiitrddi
 61 qknppvndla diirkmpgvn ltgnsasgtr gnnrqidirg mgpentlvli dgvpvtsrns
121 vryswrgerd trgdtnwvpp emverievir gpaaarygsg aaggvvniit krptndwhgs
181 lslytnqpes skegdtrrgn fslsgplagd tltmrlygnl nrtdadswdi nssagtknaa
241 gregvtnkdi nsvfswrmtp qqildfeagy srqgniyagd tqnstsnavt kslaqsgret
301 nrlyrqnygl thngiwdwgq srlgfyyekt dntrmnegls gggegritnd qtfttnrlts
361 yrtsgevnvp viwlfeqtlt vgaewnrdel ndpsstsltv kdsniagipg saanrssknk
421 seisalyved niepmagtni ipglrfdyls esgsnfspsl nlsqelgeyv kvkagiaraf
481 kapnlyqtse gyllyskgng cpkditsggc ylvgnknldp eisinkeigl eftvddyhas
541 vtyfrndyqn kivagdqiig rsasgayvlq wqnggkalie gieasmavpl mpdrlnwntn
601 atymitseqk dtgnplsiip kytvntfldw titsalsanv nwtlygkqkp rthaesrsee
661 tkglsgkalg ayslvganvn ydinknlrln vgisnifdkq iyrsaegant ynepgrayya
721 gvtasf
```

Figure 29

```
  1 mfrfnpfvrv glcmsavtla wpvaaatddg etmvvtasai eqnlkdapas isvitqqdlq
 61 rrpvqnlkdv lkevpgvqlt negdnrkgvs irgldssytl ilidgkrvns rnavfrhndf
121 dlnwipvdai erievvrgpm sslygsdalg gvvniitkki gqkwhgsvtv dstiqehrdr
181 gdtyngqfft sgplidgvlg mkaygslakr ekdeqqssat tatgetprie gftsrdgnve
241 fawtpnenhd vtagygfdrq drdsdsldkn rlerqnyals hngrwdlgns elkfygekve
301 nknpgnsspi tsesnsidgk yvlplasvnq fltfggewrh dklsdavslt ggsstktsas
361 qyalfledew rifeplaltt girmddhety gdhwsprayl vynatdtltv kggwatafka
421 psllqlspdw atnscrggcr ivgspdlkpe tseswelgly yrgeegileg veasvttfrn
481 dvdnrisisr tpdvnaapgy snfvgfetns rgqrvpvfry ynvnkariqg vetelkvpfn
541 eawklslnyt yndgrdvsng gnkplsdlpf htangtldwk paqledwsfy vsgnytgrkr
601 adsataktpg gyvvwdtgaa wqatknvklr agvlnvgdkd lkrddygyte dgrryfmavd
661 yrf
```

Figure 30

```
  1 mqmkkllpil iglslsgfst lsqaenlmqv yqqarlsnpe lrksaadrda afekinears
 61 pllpqlglga dytysngyrd anginsnets aslqltqtlf dmskwrgltl qekaagiqdv
121 tyqtdqqtli lntanayfkv lnaidvlsyt qaqkeaiyrq ldqttqrfnv glvaitdvqn
181 araqydtvla nevtarnnld naveelrqvt gnyypelasl nvehfktdkp kavnallkea
241 enrnlsllqa rlsqdlareq irqaqdghlp tlnltastgi sdtsysgskt nsaqyddsnm
301 gqnkiglnfs lplyqggmvn sqvkqaqynf vgaseqlesa hrsvvqtvrs sfnninasis
361 sinaykqavv saqssldame agysvgtrti vdvldatttl ydakqqlana rytylinqln
421 ikyalgtlne qdllalnstl gkpiptspes vapetpeqda aadgynahsa apavqptaar
481 ansnngnpfr h
```

Figure 31

```
  1 vkvlsllvpa llvagaanaa eiynkdgnkl dlfgkvdglh yfsddkgsdg dqtymrigfk
 61 getqvndqlt gygqweyqiq gnqtegsnds wtrvafaglk fadagsfdyg rnygvtydvt
121 swtdvlpefg gdtygadnfm qqrgngyaty rntdffglvd gldfalqyqg kngsvsgent
181 ngrsllnqng dgyggsltya igegfsvgga ittskrtadq nntadehlyg ngdratvytg
241 glkydanniy laaqysqtyn atrfgtsngn nkstsygfan kaqnfevvaq yqfdfglrps
301 vaylqskgkd isngygasyg dqdivkyvdv gatyyfnknm st
```

Figure 32

```
  1 mklklvavav tsllaagvvn aaevynkdgn kldlygkvha qhyfsddngs dgdktyarlg
 61 fkgetqindq ltgfgqweye fkgnrtesqg adkdktrlaf aglkfadygs fdygrnygva
121 ydigawtdvl pefggdtwtq tdvfmtgrtt gvatyrntdf fglveglnfa aqyqgkndrd
181 gayesngdgf glsatyeyeg fgvgaayaks drtnnqvkaa snlnaagkna evwaaglkyd
241 anniylatty setlnmttfg edaagdafia nktqnfeava qyqfdfglrp siaylkskgk
301 nlgtygdqdl veyidvgaty yfnknmstfv dykinlldds dftkaakvst dnivavglny
361 qf
```

Figure 33

```
  1 mkktaiaiav alagfatvaq aapkdntwya gaklgwsqyh dtgfihndgp thenqlgaga
 61 fggyqvnpyv gfemgydwlg rmpykgdnin gaykaqgvql taklgypitd dldvytrlgg
121 mvwradtksn vpggpstkdh dtgvspvfag gieyaitpei atrleyqwtn nigdantigt
181 rpdngllsvg vsyrfgqqea apvvapapap apevqtkhft lksdvlfnfn kstlkpegqq
241 aldqlysqls nldpkdgsvv vlgftdrigs daynqglsek raqsvvdyli skgipsdkis
301 argmgesnpv tgntcdnvkp raalidclap drrveievkg vkdvvtqpqa
```

Figure 34

```
  1 mnkkihsltl lvnlgiygaa lpvmaeektd saaltnedti vvtaaqqnlq apgvstitad
 61 eirknppard vseiirtmpg vnltgnstsg qrgnnrqidi rgmgpentli lidgkpvtsr
121 nsvrlgwrge rdtrgdtawv ppemieriev lrgpaaaryg ngaaggvvni itkkggsewh
181 gswntyfnap ehkdegatkr tnfslngplg gdfsfrlygn ldktqadarn inqghqsert
241 gsyadtlpag regvinkdin gvvrwdfapl qsleleagys rqgnlyagdt qntntnqlvk
301 dnygketnrl yrqnysltwn ggwdngvtts nwvqyehtrn srmpeglagg tegifdpkas
361 qkyadadlnd vtlhsevslp fdllvnqnlt lgtewaqqrm kdqlsnsqtf mggnipgyss
421 tnrspyskae ifslfaennm eltdstmltp girfdhhsiv gdnwspslnl sqglgddftl
481 kmgiarayka pslyqtnpny ilyskgqgcy atgagtgigc ymmgnddlka etsinkeigl
541 efkrdgwlag vtwfrndyrn kieagtvplq rinngktdvy qwenvpkavv eglegtlnvp
601 vsdtvnwtnn vtymlqsknk etgerlsiip qytlnstlsw qvrqdvslqs tftwygkqep
661 kkydyqgnpv tgtdkqavsp ysivglsatw dvtknvsltg gvdnlfdkrl wregnaqtvr
721 dtqtgaymag agaytynepg rtwymsinth f
```

Figure 35

```
  1 mgmrvkkfiw litvvstgvn splsaaestd dngetmvves taeqvlkqqp gvsiitrddi
 61 qknppvndla diirkmpgvn ltgnsasgtr gnnrqidirg mgpentlvli dgvpvtsrns
121 vryswrgerd trgdtnwvpp emverievir gpavarygsg aaggvvniit krptndwhgs
181 lslytnqpes skegdtrrgn fslsgplagd tltmrlygnl nrtdadswdi nssagtknaa
241 gregvtnkdi nsvfswkmtp qqildfeagy srqgniyagd tqnstsnavt kslaqsgret
301 nrlyrqnygl thngiwdwgq srlgfyyekt dntrmnegls gggegritnd qtfttnrlts
361 yrtsgevnvp viwlfeqtlt vgaewnrdel ndpsstsltv kdsniagipg saanrssknk
421 seisalyved niepmagtni ipglrfdyls esgsnfspsl nlsqelgeyv kvkagiaraf
481 kapnlyqtse gyllyskgng cpkditsggc ylvgnknldp eisinkeigl eftvddyhas
541 vtyfrndyqn kivagdqiig rsasgayvlq wqnggkalie gieasmavpl mpdrlnwntn
601 atymiaseqk dtgnplsiip kytvntfldw titsalsanv nwtlygkqkp rthaesrsee
661 tkglsgkalg ayslvganvn ydinknlrln vgisnifdkq iyrsaegant ynepgrayya
721 gvtasf
```

Figure 36

```
  1 mfrfnpfvrv glcmsavtla wpvaaatddg etmvvtasai eqnlkdapas isvitqqdlq
 61 rrpvqnlkdv lkevpgvqlt negdnrkgvs irgldssytl ilidgkrvns rnavfrhndf
121 dlnwipvdai erievvrgpm sslygsdalg gvvniitkki gqkwhgsvtv dstiqehrdr
181 gdtyngqfft sgplidgvlg mkaygslakr ekdeqqssat tatgetprie gftsrdgnve
241 fawtpnenhd vtagygfdrq drdsdsldkn rlerqnyals hngrwdlgns elkfygekve
301 nknpgnsspi tsesnsidgk yvlplasvnq fltfggewrh dklsdavslt ggsstktsas
361 qyalfledew rifeplaltt girmddhety gdhwsprayl vynatdtltv kggwatafka
421 psllqlspdw atnscrggcr ivgspdlkpe tseswelgly yrgeegileg veasvttfrn
481 dvdnrisisr tpdvnaapgy snfvgfetns rgqrvpvfry ynvnkariqg vetelkvpfn
541 eawklslnyt yndgrdvsng gnkplsdlpf htangtldwk paqledwsfy vsgnytgrkr
601 adsataktpg gyvvwdtgaa wqatknvklr agvlnvgdkd lkrddygyte dgrryfmavd
661 yrf
```

Figure 37

```
  1 mkvkvlslllv pallvagaan aaeiynkdgn kldlfgkvdg lhyfsddkgs dgdqtymrig
 61 fkgetqvndq ltgygqweyq iqgnqtegsn dswtrvafag lkfadagsfd ygrnygvtyd
121 vtswtdvlpe fggdtygadn fmqqrgngya tyrntdffgl vdgldfalqy qgkngsvsge
181 ntngrsllnq ngdgyggslt yaigegfsvg gaittskrta dqnntanarl ygngdratvy
241 tgglkydann iylaaqysqt ynatrfgtsn gsnpstsygf ankaqnfevv aqyqfdfglr
301 psvaylqskg kdisngygas ygdqdivkyv dvgatyyfnk nmstyvdyki nlldkndftr
361 dagintddiv alglvyqf
```

Figure 38

```
  1 mklklvavav tsllaagvvn aaevynkdgn kldlygkvha qhyfsddngs dgdktyarlg
 61 fkgetqindq ltgfgqweye fkgnrtesqg adkdktrlaf aglkfadygs fdygrnygva
121 ydigawtdvl pefggdtwtq tdvfmtgrtt gvatyrntdf fglveglnfa aqyqgkndrd
181 gayesngdgf glsatyeyeg fgvgaayaks drtnnqvkaa snlnaagkna evwaaglkyd
241 anniylatty setlnmttfg edaagdafia nktqnfeava qyqfdfglrp siaylkskgk
301 nlgtygdqdl veyidvgaty yfknmstfv dykinlllddds dftkaakvst dnivavglny
361 qf
```

Figure 39

```
  1 mkktaiaiav alagfatvaq aapkdntwya gaklgwsqyh dtgfihndgp thenqlgaga
 61 fggyqvnpyv gfemgydwlg rmpykgdnin gaykaqgvql taklgypitd dldvytrlgg
121 mvwradtksn vpggpstkdh dtgvspvfag gieyaitpei atrleyqwtn nigdantigt
181 rpdngllsvg vsyrfgqqea apvvapapap apevqtkhft lksdvlfnfn kstlkpegqq
241 aldqlysqls nldpkdgsvv vlgftdrigs dayngqglsek raqsvvdyli skgipsdkis
301 argmgesnpv tgntcdnvkp raalidclap drrveievkg vkdvvtqpqa
```

Figure 40

```
  1 mnkkihsltl lvnlgiygat lpvmaedktd saaltnedti vvtaaqqnlq apgvstitad
 61 eirknppard vseiirtmpg vnltgnstsg qrgnnrqidi rgmgpentli lidgkpvtsr
121 nsvrlgwrge rdtrgdtawv ppemieriev lrgpaaaryg ngaaggvvni itkkggsewh
181 gswntyfnap ehkdegatkr tnfslngplg gdfsfrlygn ldktqadarn inqghqsert
241 gsyadtlpag regvinkdin gvvrwdfapl qsleleagys rqgnlyagdt qntntnqlvk
301 dnygketnrl yrqnysltwn ggwnngvtts nwvqyehtrn srmpeglagg tegifdpkas
361 qkyadadlnd vtlhsevslp fdllvnqnlt lgtewaqqrm kdqlsnsqtf mggnipgyss
421 tnrspyskae ifslfaennm eltdstmltp glrfdhhsiv gdnwspslnl sqglgddftl
481 kmgiarayka pslyqtnpny ilyskgqgcy atgagtgigc ymmgnddlka etsinkeigl
541 efkrdgwlag vtwfrndyrn kieagtvplq rinngktdvy qwenvpkavv eglegtlnvp
601 vsdtvnwtnn vtymlqsknk etgerlsiip qytlnstlsw qvrqdvslqs tftwygkqep
661 kkydyqgnpv tgtdkqavsp ysivglsatw dvtknvsltg gvdnlfdkrl wregnaqtvr
721 dtqtgaymag agaytynepg rtwymsinth f
```

Figure 41

```
  1 mgmrvkkfiw litvvstgvn splsaaestd dngetmvves taeqvlkqqp gvsiitrddi
 61 qknppvndla diirkmpgvn ltgnsasgtr gnnrqidirg mgpentlvli dgvpvtsrns
121 vryswrgerd trgdtnwvpp emverievir gpavarygsg aaggvvniit krptndwhgs
181 lslytnqpes skegdtrrgn fslsgplagd tltmrlygnl nrtdadswdi nssagtknaa
241 gregvtnkdi nsvfswkmtp qqildfeagy srqgniyagd tqnstsnavt kslaqsgret
301 nrlyrqnygl thngiwdwgq srlgfyyekt dntrmnegls gggegritnd qtfttnrlts
361 yrtsgevnvp viwlfeqtlt vgaewnrdel ndpsstsltv kdsniagipg saanrssknk
421 seisalyved niepmagtni ipglrfdyls esgsnfspsl nlsqelgeyv kvkagiaraf
481 kapnlyqtse gyllyskgng cpkditsggc ylvgnknldp eisinkeigl eftvddyhas
541 vtyfrndyqn kivagdqiig rsasgayvlq wqnggkalie gieasmavpl mpdrlnwntn
601 atymiaseqk dtgnplsiip kytvntfldw titsalsanv nwtlygkqkp rthaesrsee
661 tkglsgkalg ayslvganvn ydinknlrln vgisnifdkq iyrsaegant ynepgrayya
721 gvtasf
```

Figure 42

```
  1 mfrfnpfvrv glcmsavtla wpvaaatddg etmvvtasai eqnlkdapas isvitqqdlq
 61 rrpvqnlkdv lkevpgvqlt negdnrkgvs irgldssytl ilidgkrvns rnavfrhndf
121 dlnwipvdai erievvrgpm sslygsdalg gvvniitkki gqkwhgsvtv dstiqehrdr
181 gdtyngqfft sgplidgvlg mkaygslakr ekdeqqssat tatgetprie gftsrdgnve
241 fawtpnenhd vtagygfdrq drdsdsldkn rlerqnyals hngrwdlgns elkfygekve
301 nknpgnsspi tsesnsidgk yvlplasvnq fltfggewrh dklsdavnlt ggsstktsas
361 qyalfledew rifeplaltt girmddhety gdhwsprayl vynatdtltv kggwatafka
421 psllqlspdw atnscrggcr ivgspdlkpe tseswelgly yrgeegileg veasvttfrn
481 dvdnrisisr tpdvnaapgy snfvgfetns rgqrvpvfry ynvnkariqg vetelkvpfn
541 eawklslnyt yndgrdvsng gnkplsdlpf htangtldwk pvqledwsfy vsgnytgrkr
601 adsataktpg gyvvwdtgaa wqatknvklr agvlnvgdkd lkrddygyte dgrryfmavd
661 yrf
```

Figure 43

```
  1 aqvintnsls lltqnnlnks qsslssaier lssglrinsa kddaagqaia nrftsnikgl
 61 tqasrnandg isiaqttega lneinnnlqr vrelsvqatn gtnsdsdlks iqdeiqqrle
121 eidrvsnqtq fngvkvlsqd nqmkiqvgan dgetitidlq kidvkslgld gfnvngpkea
181 tvgdlkssfk nvtgydtyaa gadkyrvdin sgavvtdaaa pdkvyvnaan gqlttddaen
241 ntavdlfktt kstagtaeak aiagaikggk egdtfdykgv tftidtktgd ggngkvstti
301 ngekvtltva diatgatnvn aatlqssknv ytsvvngqft fddktknesa klsdleanna
361 vkgeskitvn gaeytanatg dkitlagktm fidktasgvs tlinedaaaa kkstanplas
421 idsalskvda vrsslgaiqn rfdsaitnlg ntvtnlnsar sriedadyat evsnmskaqi
481 lqqagtsvla qanqvpqnvl sllr
```

Figure 44

```
  1 mqmkkllpil iglslsgfst lsqaenlmqv yqqarlsnpe lrksaadrda afekinears
 61 pllpqlglga dytysngyrd anginsnets aslqltqtlf dmskwrgltl qekaagiqdv
121 tyqtdqqtli lntanayfkv lnaidvlsyt qaqkeaiyrq ldqttqrfnv glvaitdvqn
181 araqydtvla nevtvrnnld naveelrqvt gnyypelasl nvehfktdkp kavnallkea
241 enrnlsllqa rlsqdlareq irqaqdghlp tlnltpstgi sdtsysgskt naaqyddsnm
301 gqnkiglnfs lplyqggmvn sqvkqaqynf vgaseqlesa hrsvvqtvrs sfnninasis
361 sinaykqavv saqssldame agysvgtrti vdvldatttl ydakqqlana rytylinqln
421 ikyalgtlne qdllalnstl gkpiptspes vapetpdqdc aadgynahsa apavqptaar
481 ansnngnpfr h
```

Figure 45

```
  1 ltqnnlnksq sslssaierl ssglrinsak ddaagqaian rftsnikglt qasrnandgi
 61 siaqttegal neinnnlqrv relsvqatng tnsdsdlksi qdeiqqrlee idrvsnqtqf
121 ngvkvlsqdn qmkiqvgand getitidlqk idvkslgldg fnvngpkeat vgdlkssfkn
181 vtgydtyaag adkyrvdins gavvtdaaap dkvyvnaang qlttddaenn tavdlfkttk
241 stagtaeaka irgaikggke gdtfdykgvt ftidtktgdd gngkvsttin gekvtltvad
301 iatgatdvna atlqssknvy tsvvngqftf ddktknesak lsdleannav kgeskitvng
361 aeytanatgd kitlagktmf idktasgvst linedaaaak kstanplasi dsalskvdav
421 rsslgaiqnr fdsaitnlgn tvtnlnsars riedadyate vsnmskaqil qqagtsvlaq
481 anqvpqnvls llr
```

Figure 46

```
  1 msfsqavsgl naaatnldvi gnniansaty gfksgtasfa dmfagskvgl gvkvagitqd
 61 ftdgtttntg rgldvaisqn gffrlvdsng svfysrngqf kldenrnlvn mqgmqltgyp
121 atgtpptiqq ganpapitip ntlmaakstt tasmqinlns tdpvpsktpf svsdadsynk
181 kgtvtvydsq gnahdmnvyf vktkdnewav ythdssdpaa tapttasttl kfnengiles
241 ggtvnittgt ingataatfs lsflnsmqqn tgannivatn qngykpgdlv syqinndgtv
301 vgnysneqeq vlgqivlanf anneglasqg dnvwaatqas gvallgtags gnfgkltnga
361 leasnvdlsk elvnmivaqr nyqsnaqtik tqdqilntlv nlr
```

Figure 47

```
  1 mkvkvlsllv pallvagaan aaeiynkdgn kldlfgkvdg lhyfsddkgs dgdqtymrig
 61 fkgetqvndq ltgyqqweyq iqgnqtegsn dswtrvafag lkfadagsfd ygrnygvtyd
121 vtswtdvlpe fggdtygadn fmqqrgngya tyrntdffgl vdgldfalqy qgkngsvsge
181 ntngrsllnq ngdgyggslt yaigegfsvg gaittskrta dqnntanarl yngndratvy
241 tgglkydann iylaaqysqt ynatrfgtsn gsnpstsygf ankaqnfevv aqyqfdfglr
301 psvaylqskg kdisngygas ygdqdivkyv dvgatyyfnk nmstyvdyki nlldkndftr
361 dgintddiva lglvyqf
```

Figure 48

```
  1 mkktaiaiav alagfatvaq aapkdntwya gaklgwsqyh dtgfihndgp thenqlgaga
 61 fggyqvnpyv gfemgydwlg rmpykgdnin gaykaqgvql taklgypitd dldvytrlgg
121 mvwradtksn vpggpstkdh dtgvspvfag gieyaitpei atrleyqwtn nigdantigt
181 rpdngllsvg vsyrfgqqea apvvapapap apevqtkhft lksdvlfnfn kstlkpegqq
241 aldqlysqls nldpkdgsvv vlgftdrigs dayngglsek raqsvvdyli skgipsdkis
301 argmgesnpv tgntcdnvkp raalidclap drrveievkg vkdvvtqpqa
```

Figure 49

```
  1 mnkkihslal lvnlgiygva qaqeptdtpv shddtivvta aeqnlqapgv stitadeirk
 61 npvardvsei irtmpgvnlt gnstsgqrgn nrqidirgmg pentlilidg kpvssrnsvr
121 qgwrgerdtr gdtswvppem ierievlrgp aaarygngaa ggvvniitkk gsgewhgswd
181 ayfnapehke egatkrtnfs ltgplgdefs frlygnldkt qadawdinqg hqsaragtya
241 ttlpagregv inkdingvvr wdfaplqsle leagysrqgn lyagdtqntn sdaytrskyg
301 detnrlyrqn ysltwnggwd ngvttsnwvq yehtrnsrip eglaggtegk fnekatqdfv
361 dndlddvmlh sevnlpidfl vnqtltlgte wnqqrmkdls sntqaltgtn tggaidgvsa
421 tdrspyskae ifslfaennm eltdstivtp glrfdhhsiv gnnwspalni sqglgddftl
481 kmgiarayka pslyqtnpny ilyskgqgcy asaggcylqg nddlkaetsi nkeiglefkr
541 dgwlagitwf rndyrnkiea gyvavgqnav gtdlyqwdnv pkavvegleg slnvpvsetv
601 mwtnnnityml ksenkttgdr lsiipeytln stlswqared lsmqttftwy gkqqpkkyny
661 kgqpavgpet keispysivg lsatwdvtkn vsltggvdnl fdkrlwragn aqttgdlaga
721 nyiagagayt ynepgrtwym svnthf
```

Figure 50

```
  1 marsktaqpk hslrkiavvv atavsgmsvy aqaavelked titvtaapap qesawgpaat
 61 iaarqsatgt ktdtpiqkvp qsisvvtaee malhqpksvk ealsytpgvs vgtrgasnty
121 dhliirgfaa egqsqnnyln glklqgnfyn davidpymle raeimrgpvs vlygksspgg
181 llnmvskrpt teplkevqfk agtdslfqtg fdfsdalddd gvysyrltgl arsanaqqkg
241 seeqryaiap aftwrpddkt nftflsyfqn epetgyygwl pkegtveplp ngkrtpdfn
301 egaknntysr nekmvgysfd hefndtftvr qnlrfaenkt sqnsvygygv csdpanaysk
361 qcaalapadk ghylarkyvv ddeklqnfsv dtqlqskfat gdidhtlltg vdfmrmrndi
421 nawfgyddsv plldlynpvn tdfdfnakdp ansgpyriln kqkqtgvyvq dqaqwdkvlv
481 tlggrydwad qeslnrvagt tdkrddkqft wrggvnylfd ngvtpyfsys esfepssqvg
541 kdgnlfapsk gkqyevgvky vpedrpivvt gavynltktn nlmadpegsf fsveggeira
601 rgveieakaa lsasvnvvgs ytytdaeytt dttykgntpa qvpkhmaslw adytffdgpl
661 sgltlgtggr ytgssygdpa nsfkvgsytv vdalvrydla rvgmagsnva lhvnnlfdre
721 yvascfntyg cfwgaerqvv atatfrf
```

Figure 51

```
  1 mivsasgyek kltnaaasvs visqeelqss qyhdlaealr svegvdvesg tgktggleis
 61 irgmpasytl ilidgvrqgg ssdvtpngfs amntgfmppl aaierievir gpmstlygsd
121 amggvvniit rknadkwlss vnaglnlqes nkwgnssqfn fwssgplvdd svslqvrgst
181 qqrqgssvts lsdtaatrip yptesqnynl garldwkase qdvlwfdmdt trqrydnrdg
241 qlgsltggyd rtlryernki sagydhtftf gtwksylnwn etenkgrelv rsvlkrdkwg
301 lagqprelke snlilnslll tplgeshlvt vggefqsssm kdgvvlastg etfrqkswsv
361 faedewhltd alaltagsry ehheqfgghf spraylvwdv adawtlkggv ttgykaprmg
421 qlhkgisgvs gqgktnllgn pnlkpeesvs yeagvyydnp aglnanvtgf mtdfsnkivs
481 ysindntnsy vnsgkarlhg vefagtlplw sedvtlslny twtrseqrdg dnkgaplsyt
541 pehmvnakln wqiteevasw lgaryrgktp rftqnyssls avqkkvydek qeylkawtvv
601 daglswkmtd altlnaavnn llnkdysdvs lysagkstly agdyfqtgss ttgyvipern
661 ywmslnyqf
```

Figure 52

```
  1 msrpqftslr lsllalavsa tlptfafate tmtvtatgna rssfeapmmv svidtsapen
 61 qtatsatdll rhvpgitldg tgrtngqdin mrgydhrgvl vlvdgirqgt dtghlngtfl
121 dpalikrvei vrgpsallyg sgalggvisy dtvdakdllq egqssgfrvf gtggtgdhsl
181 glgasafgrt enldgivaws srdrgdlrqs ngetapndes innmlakgtw qidsaqslsg
241 lvryynndar epknpqtvea sessnpmvdr stiqrdaqls yklapqgndw lnadakiyws
301 evrinaqntg ssgeyreqit kgarlenrst lfadsfashl ltyggeyyrq eqhpggattg
361 fpqakidfss gwlqdeitlr dlpitllggt rydsyrgssd gykdvdadkw ssragmtinp
421 tnwlmlfgsy aqafraptmg emyndskhfs igrfytnywv pnpnlrpetn etqeygfglr
481 fddlmlsnda lefkasyfdt kakdyisttv dfaaattmsy nvpnakiwgw dvmtkyttdl
541 fsldvaynrt rgkdtdtgey issinpdtvt stlnipiahs gfsvgwvgtf adrsthisss
601 yskqpgygvn dfyvsyqgqq alkgmtttlv lgnafdkeyw spqgipqdgr ngkifvsyqw
```

Figure 53

```
  1 maqvintnsl slitqnnink nqsalsssie rlssglrins akddaagqai anrftsnikg
 61 ltqaarnand gisvaqtteg alseinnnlq rireltvqat tgtnsdsdld siqdeiksrl
121 deidrvsgqt qfngvnvlak dgsmkiqvga ndgetitidl kkidsdtlgl ngfnvngkgt
181 itnkaatvsd ltsagaklnt ttglydlkte ntllttdaaf dklgngdkvt vggvdytyna
241 ksgdfttttks tagtgvdaaa qaadsaskrd alaatlhadv gksvngsytt kdgtvsfetd
301 sagnitiggs qayvddagnl ttnnagsaak admkalxkaa segsdgaslt fngteytiak
361 atpatttpva plipggityq atvskdvvls etkaaaatss itfnsgvlsk tigftagess
421 daaksyvddk ggitnvadyt vsysvnkdng svtvagyasa tdtnkdyapa igtavnvnsa
481 gkittettsa gsattnplaa lddaissidk frsslgaiqn rldsavtnln ntttnlseaq
541 sriqdadyat evsnmskaqi iqqagnsvla kanqvpqqvl sllqg
```

Figure 54

```
  1 mikkasllta csvtafsawa qdtspdtlvv tanrfeqprs tvlapttvvt rqdidrwqst
 61 svndvlrrlp gvditqnggs gqlssifirg tnashvlvli dgvrlnlagg sgsadlsqfp
121 ialvqrveyi rgprsavygs daiggvvnii ttrdepgtei sagwgsnsyq nydvstqqql
181 gdktrvtllg dyahthgydv vaygntgtqa qpdndgflsk tlygalehnf tdawsgfvrg
241 ygydnrtnyd ayyspgsplv dtrklysqsw daglryngel iksqlitsys hskdynydph
301 ygrydssatl demkqytvqw anniiighgn vgagvdwqkq stapgtayvk dgydqrntgi
361 yltglqqvgd ftfegaarsd dnsqfgrhgt wqtsagwefi egyrfiasyg tsykapnlgq
421 lygfygnpnl dpekskqweg afegltagvn wrisgyrndv sdlidyddht lkyynegkar
481 ikgveatanf dtgplthtvs ydyvdarnai tdtpllrrak qqvkyqldwq lydfdwgity
541 qylgtrydkd yssypyqtvk mggvslwdla vaypvtshlt vrgkianlfd kdyetvygyq
601 tagreytlsg sytf
```

Figure 55

```
  1 mqmkkllpil iglslsgfss lsqaenlmqv yqqarlsnpe lrksaadrda afekinears
 61 pllpqlglga dytysngyrd anginsnats aslqltqsif dmskwraltl qekaagiqdv
121 tyqtdqqtli lntatayfnv lnaidvlsyt qaqkeaiyrq ldqttqrfnv glvaitdvqn
181 araqydtvla nevtarnnld naveqlrqit gnyypelaal nvenfktdkp qpvnallkea
241 ekrnlsllqa rlsqdlareq irqaqdghlp tldltassgi sdtsysgskt rgaagtqydd
301 snmgqnkvgl sfslpiyqgg mvnsqvkqaq ynfvgaseql esahrsvvqt vrssfnnina
361 sissinaykq avvsaqssld ameagysvgt rtivdvldat ttlynakqel anarynylin
421 qlniksalgt lneqdllaln nalskpvstn penvapqtpe qnaiadgyap dspapvvqqt
481 sartttsngh npfrn
```

Figure 56

```
  1 mkvkvlsllv pallvagaan aaevynkdgn kldlygkvdg lhyfsddksv dgdqtymrlg
 61 fkgetqvtdq ltgygqweyq iqgnsaenen nswtrvafag lkfqdvgsfd ygrnygvvyd
121 vtswtdvlpe fggdtygsdn fmqqrgngfa tyrntdffgl vdglnfavqy qgkngsvsge
181 gmtnngreal rqngdgvggs itydyegfgi gaavsssskrt ddqnsplyig ngdraetytg
241 glkydanniy laaqytqtyn atrvgslgwa nkaqnfeava qyqfdfglrp slaylqskgk
301 nlgvingrny ddedilkyvd vgatyyfnkn mstyvdykin llddnqftrd agintdniva
361 lglvyqf
```

Figure 57

```
  1 mkktaiaiav alagfatvaq aapkdntwyt gaklgwsqyh dtgfinnngp thenqlgaga
 61 fggyqvnpyv gfemgydwlg rmpykgsven gaykaqgvql taklgypitd dldiytrlgg
121 mvwradtksn vygknhdtgv spvfaggvey aitpeiatrl eyqwtnnigd ahtigtrpdn
181 gmlslgvsyr fgqgeaapvv apapapapev qtkhftlksd vlfnfnkatl kpegqaaldq
241 lysqlsnldp kdgsvvvlgy tdrigsdayn qqlserraqs vvdyliskgi padkisargm
301 gesnpvtgnt cdnvkqraal idclapdrrv eievkgikdv vtqpqa
```

Figure 58

```
  1 mstaklvksk atnllytrnd vsdsekkatv ellnrqviqf idlslitkqa hwnmrganfi
 61 avhemldgfr talidhldtm aeravqlggv algttqvins ktplksypld ihnvqdhlke
121 ladryaivan dvrkaigeak dddtadilta asrdldkflw fiesnie
```

Figure 59

```
  1 mkkriptlla tmiatalysq qglaadlasq cmlgvpsydr plvqgdtndl pvtinadhak
 61 gdypddavft gsvdimqgns rlqadevqlh qkeapgqpep vrtvdalgnv hyddnqvilk
121 gpkgwanlnt kdtnvwegdy qmvgrqgrgk adlmkqrgen rytildngsf tsclpgsdtw
181 svvgseiihd reeqvaeiwn arfkvgpvpi fyspylqlpv gdkrrsgfli pnakytttny
241 fefylpyywn iapnmdatit phymhrrgni mwenefryls qagaglmeld ylpsdkvykd
301 ehpnddssrr wlfywnhsgv mdqvwrfnvd ytkvsdpsyf ndfdnkygss tdgyatqkfs
361 vgyavqnfna tvstkqfqvf seqntssysa epqldvnyyq ndvgpfdtri ygqavhfvnt
421 rddmpeatrv hleptinlpl snnwgsinte akllathyqq tnldwynsrn ttklaesanr
481 vmpqfkvdgr mvferdmeml apgytqtlep raqylyvpyr dqskiynyds sllqsdysgl
541 frdrtyggld riasanqvtt gvtsriydda averfnisvg qiyyftesrt gddnitwend
601 dktgslvwag dtywrisdrw qlrggiqydt rldnvatsns sieyrrdedr lvqlnyryas
661 peyiqatlpk yystaeqykn gisqvgavas wpiadrwsiv gayyydtnan kqadsmlgvq
721 yssccyairv gyerklngwd ndkqhavydn aigfnielrg lssnyglgtq emlrsnilpy
781 qntl
```

Figure 60

```
  1 mnkkihslal lvnlgiygva qaqeptdtpv shddtivvta aeqnlqapgv stitadeirk
 61 npvardvsei irtmpgvnlt gnstsgqrgn nrqidirgmg pentlilidg kpvssrnsvr
121 qgwrgerdtr gdtswvppem ierievlrgp aaarygngaa ggvvniitkk gsgewhgswd
181 ayfnapehke egatkrtnfs ltgplgdefs frlygnldkt qadawdinqg hqsaragtya
241 ttlpagregv inkdingvvr wdfaplqsle leagysrqgn lyagdtqntn sdaytrskyg
301 detnrlyrqn ysltwnggwd ngvttsnwvq yehtrnsrip eglaggtegk fnekaaqdfv
361 didlddvmlh sevnlpidfl vnqtltlgte wnqqrmkdls sntqaltgtn tggaidgvsa
421 tdrspyskae ifslfaennm eltdstivtp glrfdhhsiv gnnwspalni sqglgddftl
481 kmgiarayka pslyqtnpny ilyskgqgcy asaggcylqg nddlkaetsi nkeiglefkr
541 dgwlagvtwf rndyrnkiea gyvavgqnav gtdlyqwdnv pkavvegleg slnvpvsetv
601 mwtnnityml ksenkttgdr lsiipeytln stlswqared lsmqttftwy gkqqpkkyny
661 kgqpavgpet keispysivg lsatwdvtkn vsltggvdnl fdkrlwragn aqttgdlaga
721 nyiagagayt ynepgrtwym sinthf
```

Figure 61

```
  1 mrinkilwsl tvllvglnsq vsvakssddd ndetlvveat aeqvlkqqpg vsvitsedik
 61 ktppvndlsd iirkmpgvnl tgnsasgtrg nnrqidirgm gpentlilid gvpvtsrnsv
121 ryswrgerdt rgdtnwvppe qverievirg paaarygsga aggvvniitk rptndwhgsl
181 slytnqpess degatrranf slsgplagna lttrlygnln ktdadswdin spvgtknaag
241 hegvrnkdin gvvswklnpq qildfeagys rqgniyagdt qnssssavte slaksgketn
301 rlyrqnygit hngiwdwgqs rfgvyyektn ntrmneglsg ggegrilage kfttnrlssw
361 rtsgelnipl nvmvdqtltv qaewnrdkld dpsstsltvn dsdisgisgs aadrssknhs
421 qisalyiedn iepvpgtnii pglrfdylsd sggnfspsln lsqelgdyfk vkagvartfk
481 apnlyqsseg yllyskgngc pkditsggcy lignkdldpe isvnkeigle ftwedyhasv
541 tyfrndyqnk ivagdnvigq tasgayilkw qnggkalvdg ieasmsfplv kdrlnwntna
601 twmitseqkd tgnplsvipk ytinnslnwt itqafsasvn wtlygrqkpr thaetrsedt
661 gglsgkelga yslvgtnfny dinknlrlnv gvsnilnkqi frsseganty nepgrayyag
721 vtasf
```

Figure 62

```
  1 mknkyiiapg iavmcsavis sgyassdkke dtlvvtasgf tqqlrnapas vsvitseqlq
 61 kkpvsdlvda vkdvegisit ggnekpdisi rglsgdytli lvdgrrqsgr esrpngsggf
121 eagfippvea ierievirgp msslygsdai ggviniitkp vnnqtwdgvl glggiiqehg
181 kfgnsttndf ylsgplikdk lglqlyggmn yrkedsisqg tpakdnknit atlqftptes
241 qkfvfeygkn nqvhtltpge sldawtmrgn lkqpnskret hnsrshwvaa wnaqgeilhp
301 eiavyqekvi revksgkkdk ynhwdlnyes rkpeitntii dakvtaflpe nvltiggqfq
361 haelrddsat gkkttetqsv sikqkavfie neyaatdsla ltgglrldnh eiygsywnpr
421 lyavynltdn ltlkggiaka frapsirevs pgfgtltqgg asimygnrdl kpetsvteei
481 giiysndsgf sasatlfntd fknkltsydi gtkdpvtgln tfiydnvgea nirgvelatq
541 ipvydkwhvs anytftdsrr ksddeslngk slkgeplert prhaanakle wdytqditfy
601 sslnytgkqi waaqrngakv prvrngftsm diglnyqilp dtlinfavln vtdrksedid
661 tidgnwqvde grrywanvrv sf
```

Figure 63

```
  1 msrpqftslr lsllalavsa tlptfafate tmtvtatgna rssfeapmmv svidtsapen
 61 qtatsatdll rhvpgitldg tgrtngqdvn mrgydhrgvl vlvdgvrqgt dtghlngtfl
121 dpalikrvei vrgpsallyg sgalggvisy dtvdakdllq egqssgfrvf gtggtgdhsl
181 glgasafgrt enldgivaws srdrgdlrqs ngetapndes innmlakgtw qidsaqslsg
241 lvryynndar epknpqtvga sessnpmvdr stiqrdaqls yklapqgndw lnadakiyws
301 evrinaqntg ssgeyreqit kgarlenrst lfadsfashl ltyggeyyrq eqhpggattg
361 fpqakidfss gwlqdeitlr dlpitllggt rydsyrgssd gykdvdadkw ssragmtinp
421 tnwlmlfgsy aqafraptmg emyndskhfs igrfytnywv pnpnlrpetn etqeygfglr
481 fddlmlsnda lefkasyfdt kakdyisttv dfaaattmsy nvpnakiwgw dvmtkyttdl
541 fsldvaynrt rgkdtdtgey issinpdtvt stlnipiahs gfsvgwvgtf adrsthisss
601 yskqpgygvn dfyvsyqgqq alkgmtttlv lgnafdkeyw spqgipqdgr ngkifvsyqw
```

Figure 64

```
  1 mqmkkllpil iglslsgfss lsqaenlmqv yqqarlsnpe lrksaadrda afekinears
 61 pllpqlglga dytysngyrd anginsnats aslqltqsif dmskwraltl qekaagiqdv
121 tyqtdqqtli lntatayfnv lnaidvlsyt qaqkeaiyrq ldqttqrfnv glvaitdvqn
181 araqydtvla nevtarnnld naveqlrqit gnyypelaal nvenfktdkp qpvnallkea
241 ekrnlsllqa rlsqdlareq irqaqdghlp tldltassgi sdtsysgskt rgaagtqydd
301 snmgqnkvgl sfslpiyqgg mvnsqvkqaq ynfvgaseql esahrsvvqt vrssfnnina
361 sissinaykq avvsaqssld ameagysvgt rtivdvldat ttlynakqel anarynylin
421 qlniksalgt lneqdllaln nalskpvstn penvapqtpe qnaiadgyap dspapvvqqt
481 sartttsngh npfrn
```

Figure 65

```
  1 maqvintnsl slitqnnink nqsalstsie rlssglrins akddaaggai anrftsnikg
 61 ltqaarnand gislaqtteg alseinnnlq rvreltvqat tgtnsdsdls siqdeiksrl
121 deidrvsgqt qfngvnvlak dgsmkiqvga ndgqtisidl qkidsstlgl ngfsvsgqsl
181 nvsdsitqit gaagtkpvgv dftavakdlt tatgktvdvs sltlhntlda kgaatsqfvv
241 qsgndfysas inhtdgkvtl nkadveytdt dnglttaatq kdqlikvaad sdgsaagyvt
301 fqgknyattv stalddntaa katdnkvvve lstakptaqf sgassadpla lldkaiaqvd
361 tfrsslgavq nrldsavtnl nntttnlsea qsriqdadya tevsnmskaq iiqqagnsvl
421 skanqvpqqv lsllqg
```

Figure 66

```
  1 mkvkvlsllv pallvagaan aaevynkdgn kldlygkvdg lhyfsddksv dgdqtymrlg
 61 fkgetqvtdq ltgygqweyq iqgnsaenen nswtrvafag lkfqdvgsfd ygrnygvvyd
121 vtswtdvlpe fggdtygsdn fmqqrgngfa tyrntdffgl vdglnfavqy qgkngsvseg
181 mtnngrealr qngdgvggsi tydyegfgig aavsssskrtd dqnsplyign gdraetytgg
241 lkydanniyl aaqytqtyna trvgslgwan kaqnfeavaq yqfdfglrps laylqskgkn
301 lgvingrnyd dedilkyvdv gatyyfnknm styvdykinl lddnqftrda gintdnival
361 glfyqf
```

Figure 67

```
  1 mniyravtsf fnksskkgrt mkkltvaisa vaasvlmams aqaaeiynkd snkldlygkv
 61 nakhyfssnd addgdttyar lgfkgetqin dqltgfgqwe yefkgnraes qgsskdktrl
121 afaglkfgdy gsidygrnyg vaydigawtd vlpefggdtw tqtdvfmtgr ttgvatyrnn
181 dffglvdgln faaqyqgknd rtdvteangd gfgfsttyey egfgvgatya ksdrtdgqva
241 ygkskfnasg knaevwaagl kydanniyla ttysetqnmt vfgnnhiank aqnfeavaqy
301 qfdfglrpsv aylqskgkdl gvhgdrdlvk yvdvgatyyf nknmstfvdy kinliddskf
361 tktagidtdd ivavglvyqf
```

Figure 68

```
  1 mkktaiaiav alagfatvaq aapkdntwyt gaklgwsqyh dtgfinnngp thenqlgaga
 61 fggyqvnpyv gfemgydwlg rmpykgsven gaykaqgvql taklgypitd dldvytrlgg
121 mvwradtksn vygknhdtgv spvfaggvey aitpeiatrl eyqwtnnigd ahtigtrpdn
181 gmlslgvsyr fgqgeaapvv apapapapev qtkhftlksd vlftfnkatl kpeggaaldq
241 lysqlsnldp kdgsvvvlgy tdrigsdayn qalserraqs vvdyliskgi padkisargm
301 gesnpvtgnt cdnvkqraal idclapdrrv eievkgikdv vtqpqa
```

Figure 69

```
  1 mvsttylwyk arrtsdpfri hrldgsdnlt lcnnthvsah ipgcplgsvi wdtwrhnpnf
 61 yievlimatv smrdmlkagv hfghqtrywn pkmkpfifga rnkvhiinle ktvpmfneal
121 aelnkiasrk gkilfvgtkr aaseavkdaa lscdqffvnh rwlggmltnw ktvrqsikrl
181 kdletqsqdg tfdkltkkea lmrtrelekl enslggikdm gglpdalfvi dadhehiaik
241 eannlgipvf aivdtnsdpd gvdfvipgnd dairavtlyl gavaatvreg rsqdlasqae
301 esfveae
```

Figure 70

```
  1 mstaklvksk atnllytrnd vsdsekkatv ellnrqviqf idlslitkqa hwnmrganfi
 61 avhemldgfr talidhldtm aeravqlggv algttqvins ktplksypld ihnvqdhlke
121 ladryaivan dvrkaigeak dddtadilta asrdldkflw fiecnie
```

Figure 71

```
  1 mstaklvksk atnllytrnd vsdsekkatv ellnrqviqf idlslitkqa hwnmrganfi
 61 avhemldgfr talidhldtm aeravqlggv algttqvins ktplksypld ihnvqdhlke
121 ladryaivan dvrkaigeak dddtadilta asrdldkflw fiesnie
```

Figure 72

```
  1 mnkkihslal lvnlgiygva qaqeptdtpv shddtivvta aeqnlqapgv stitadeirk
 61 npvardvsei irtmpgvnlt gnstsgqrgn nrqidirgmg pentlilidg kpvssrnsvr
121 qgwrgerdtr gdtswvppem ierievlrgp aaarygngaa ggvvniitkk gsgewhgswd
181 ayfnapehke egatkrtnfs ltgplgdefs frlygnldkt qadawdinqg hqsaragtya
241 ttlpagregv inkdingvvr wdfaplqsle leagysrqgn lyagdtqntn sdaytrskyg
301 detnrlyrqn ysltwnggwd ngvttsnwvq yehtrnsrip eglaggtegk fnekaaqdfv
361 didlddvmlh sevnlpidfl vnqtltlgte wnqqrmkdls sntqaltgtn tggaidgvsa
421 tdrspyskae ifslfaennm eltdstivtp glrfdhhsiv gnnwspalni sqglgddftl
481 kmgiarayka pslyqtnpny ilyskgqgcy asaggcylqg nddlkaetsi nkeiglefkr
541 dgwlagvtwf rndyrnkiea gyvavgqnav gtdlyqwdnv pkavveqleg slnvpvsetv
601 mwtnnityml ksenkttgdr lsiipeytln stlswqared lsmqttftwy gkqqpkkyny
661 kgqpavgpet keispysivg lsatwdvtkn vsltggvdnl fdkrlwragn aqttgdlaga
721 nyiagagayt ynepgrtwym sinthf
```

Figure 73

```
  1 mtplrvfrkt tplvntirls llplaglsfs afaaqvniap gsldkalnqy aahsgftlsv
 61 dasltrgkqs nglhgdydve sglqqlldgs glqvkplgnn swtlepapap kedaltvvgd
121 wlgdarendv fehagardvi rredfaktga ttmrevlnri pgvsapenng tgshdlamnf
181 girglnprla srstvlmdgi pvpfapygqp qlslapvslg nmdaidvvrg ggavrygpqs
241 vggvvnfvtr aipqdfgiea gveqqlspts sqnnpkethn lmvggtadng fgtallysgt
301 rgsdwrehsa triddlmlks kyapdevhtf nsllqyydge admpgglsra dydadrwqst
361 rpydrfwgrr klaslgyqfq pdsqhkfniq gfytqtlrsg yleqgkritl sprnywvrgi
421 eprysqifmi gpsahevgvg yrylnesthe mryytatssg qlpsgsspyd rdtrsgteah
481 awylddkidi gnwtitpgmr fehiesyqnn aitgtheevs ynaplpalnv lyhltdswnl
541 yantegsfgt vqysqigkav qsgnvepeka rtwelgtryd dgaltaemgl flinfnnqyd
601 snqtndtvta rgktrhtgle tqarydlgtl tptldnvsiy asyayvnaei rekgdtygnl
661 vpfspkhkgt lgvdykpgnw tfnlnsdfqs sqfadnantv kesadgstgr ipgfmlwgar
721 vaydfgpqma dlnlafgvkn ifdqdyfirs yddnnkgiya gqprtlymqg slkf
```

Figure 74

```
  1 mmiskkytlw alnpllltmm apavaqqtdd etfvvsanrs nrtvaemaqt twvienaele
 61 qqiqggkelk dalaqlipgl dvssrsrtny gmnvrgrplv vlvdgvrlns srtdsrqlds
121 idpfnmhhie vifgatslyg ggstgglini vtkkgqpetm mefeagtksg fssskdhder
181 iagavsggne hisgrlsvay qkfggwfdgn gdatlldntq tglqysdrld imgtgtlnid
241 esrqlqlitq yyksqgdddy glnlkgfsa irgtstpfvs nglnsdripg terhlislqy
301 sdsaflgqel vgqvyyrdes lrfypfptvn ankqvtafss sqqdtdqygm kltlnskpmd
361 gwqitwglda dherftsnqm ffdlaqasas gglnnkkiyt tgrypsydit nlaaflqsgy
421 dinnlftlng gvryqytenk iddfigyaqq rqigagkats adafwrlsrl rhflfnagll
481 mhitepqqaw lnfsqgvelp dpgkyygrgi ygaavnghlp ltksvnvsds klegvkvdsy
541 elgwrftgnn lrtqiaayys isdksvvank dltisvvddk rriygvegav dylipdtdws
601 tgvnfnvlkt eskvngtwqk ydvktaspsk atayigwapd pwslrvqstt sfdvsdaqgy
661 kvdgyttvdl lgsyqlpvgt lsfsienlfd rdyttwgqr aplyyspgyg paslydykgr
721 gpplv
```

Figure 75

```
  1 mikkasllta csvtafsawa qdtspdtlvv tanrfeqprs tvlapttvvt rqdidrwqst
 61 svndvlrrlp gvditqnggs gqlssifirg tnashvlvli dgvrlnlagv sgsadlsqfp
121 ialvqrveyi rgprsavygs daiggvvnii ttrdepgtei sagwgsnsyq nydvstqqql
181 gdktrvtllg dyahthgydv vaygntgtqa qtdndgflsk tlygalehnf tdawsgfvrg
241 ygydnrtnyd ayyspgspll dtrklysqsw daglryngel iksqlitsys hskdynydph
301 ygrydssatl demkqytvqw annvivghgs igagvdwqkq tttpgtgyve dgydqrntgi
361 yltglqqvgd ftfegaarsd dnsqfgrhgt wqtsagwefi egyrfiasyg tsykapnlgq
421 lygfygnpnl dpekskqweg afegltagvn wrisgyrndv sdlidyddht lkyynegkar
481 ikgveatanf dtgplthtvs ydyvdarnai tdtpllrrak qqvkyqldwq lydfdwgity
541 qylgtrydkd yssypyqtvk mggvslwdla vaypvtshlt vrgkianlfd kdyetvygyq
601 tagreytlsg sytf
```

Figure 76

```
  1 mqmkkllpil iglslsgfss lsqaenlmqv yqqarlsnpe lrksaadrda afekinears
 61 pllpqlglga dytysngyrd anginsnats aslqltqsif dmskwraltl qekaagiqdv
121 tyqtdqqtli lntatayfnv lnaidvlsyt qaqkeaiyrq ldqttqrfnv glvaitdvqn
181 araqydtvla nevtarnnld naveqlrqit gnyypelaal nvenfktdkp qpvnallkea
241 ekrnlsllqa rlsqdlareq irqaqdghlp tldltassgi sdtsysgskt rgaagtqydd
301 snmgqnkvgl sfslpiyqgg mvnsqvkqaq ynfvgaseql esahrsvvqt vrssfnnina
361 sissinaykq avvsaqssld ameagysvgt rtivdvldat ttlynakqel anarynylin
421 qlniksalgt lneqdllaln nalskpvstn penvapqtpe qnaiadgyap dspapvvqqt
481 sartttsngh npfrn
```

Figure 77

```
  1 vdfhgyarsg igwtgsggeq qcfqttgaqs kyrlgnecet yaelklgqev wkegdksfyf
 61 dtnvaysvaq qndweatdpa freanvqgkn liewlpgsti wagkrfyqrh dvhmidfyyw
121 disgpgagle nidvgfgkls laatrsseag gsssfasnni ydytnetand vfdvrlaqme
181 inpggtlelg vdygranlrd nyrlvdgask dgwlftaeht qsvlkgfnkf vvqyatdsmt
241 sqgkglsqgs gvafdnekfa yninnnghml rildhgaism gdnwdmmyvg myqdinwdnd
301 ngtkwwtvgi rpmykwtpim stvmeigydn vesqrtgdkn nqykitlaqq wqagdsiwsr
361 pairvfatya kwdekwgydy tgnadnnanf gkavpadfng gsfgrgdsde wtfgaqmeiw
421 w
```

Figure 78

```
  1 mvmsqktlft ksalavaval istqawsagf qlnefsssgl graysgegai addagnvsrn
 61 palitmfdrp tfsagavyid pdvnisgtsp sgrslkadni aptawvpnmh fvapindqfg
121 wgasitsnyg latefndtya ggsvggttdl etmnlnlsga yrlnnawsfg lgfnavyara
181 kierfagdlg qlvagqimqs pagqtqqgqa laatangids ntkiahlngn qwgfgwnagi
241 lyeldknnry altyrsevki dfkgnyssdl nrafnnyglp iptatggatq sgyltlnlpe
301 mwevsgynrv dpqwaihysl aytswsqfqq lkatstsgdt lfqkhegfkd ayrialgtty
361 yyddnwtfrt giafddspvp aqnrsisipd qdrfwlsagt tyafnkdasv dvgvsymhgq
421 svkinegpyq fesegkawlf gtnfnyaf
```

Figure 79

```
  1 mniyravtsf fnksskkgrt mkkltvaisa vaasvlmams aqaaeiynkd snkldlygkv
 61 nakhyfssnd addgdttyar lgfkgetqin dqltgfgqwe yefkgnraes qgsskdktrl
121 afaglkfgdy gsidygrnyg vaydigawtd vlpefggdtw tqtdvfmtgr ttgvatyrnn
181 dffglvdgln faaqyqgknd rtdvteangd gfgfsttyey egfgvgatya ksdrtdgqva
241 ygkskfnasg knaevwaagl kydanniyla ttysetqnmt vfgnnhiank aqnfeavaqy
301 qfdfglrpsv aylqskgkdl gvhgdrdlvk yvdvgatyyf nknmstfvdy kinliddskf
361 tktagidtdd ivavglvyqf
```

Figure 80

```
  1 ddldiytrlg gmvwradtka nvpggasykd hdtgvspvfa ggveyaitpe iatrleyqwt
 61 nnigdahtig trpdngllsl gvsyrfgqge aapvvapapa papevqtkhf tlksdvlfnf
121 nkatlkpegq aaldqlysql snldpkdgsv vvlgytdrig s
```

Figure 81

```
  1 matvsmrdml kagvhfghqt rywnpkmkpf ifgarnkvhi inlektvpmf nealaelnki
 61 asrkgkilfv gtkraaseav kdaalscdqf fvnhrwlggm ltnwktvrqs ikrlkdletq
121 sqdgtfdklt kkealmrtre leklenslgg ikdmgglpda lfvidadheh iaikeannlg
181 ipvfaivdtn sdpdgvdfvi pgnddairav tlylgavaat vregrsqdla sqaeesfvea
241 e
```

Figure 82

```
  1 mkktllaaga vlalsssftv naaendkpqy lsdwwhqsvn vvgsyhtrfg pqirndtyle
 61 yeafakkdwf dfygyadapv ffggnsdakg iwnhgsplfm eieprfsidk ltntdlsfgp
121 fkewyfanny iydmgrnkdg rqstwymglg tdidtglpms lsmnvyakyq wqnygaanen
181 ewdgyrfkik yfvpitdlwg gqlsyigftn fdwgsdlgdd sgbaingikt rtnnsiassh
241 ilalnydhwh ysvvarywhd ggqwnddael nfgngnfnvr stgwggylvv gynf
```

Figure 83

```
  1 mstaklvksk atnllytrnd vsdsekkatv ellnrqviqf idlslitkqa hwnmrganfi
 61 avhemldgfr talidhldtm aeravqlggv algttqvins ktplksypld ihnvqdhlke
121 ladryaivan dvrkaigeak dddtadilta asrdldkflw fiecnie
```

Figure 84

```
  1 mstaklvksk atnllytrnd vsdsekkatv ellnrqviqf idlslitkqa hwnmrganfi
 61 avhemldgfr talidhldtm aeravqlggv algttqvins ktplksypld ihnvqdhlke
121 ladryaivan dvrkaigeak dddtadilta asrdldkflw fiesnie
```

Figure 85

```
  1 mamkkllias llfssatvyg aegfvvkdih feglqrvavg aallsmpvrt gdtvndedis
 61 ntiralfatg nfedvrvlrd gdtllvqvke rptiasitfs gnksvkddml kqnlqasgvr
121 vgesldrtti adiekgledf yysvgkysas vkavvtplpr nrvdlklvfq egvsaeiqqi
181 nivgnhaftt delishfqlr devpwwnvvg drkyqkqkla gdletlriyy ldrgyarfni
241 dstqvsltpd kkgiyvtvni tegdqyklsg vevsgnlagh saeieqltki epgelyngtk
301 vtkmeddikk llgrygyayp rvqsmpeind adktvklrvn vdagnrfyvr kirfegndts
361 rdavlrremr qmegawlgsd lvdqgkerln rlgffetvdt dtqrvpgspd qvdvvykvke
421 rntgsfnfgi gygtesgvsf qagvqqdnwl gtgyavging tkndyqtyae lsvtnpyftv
481 dgvslggrlf yndfqaddad lsdytnksyg tdvtlgfpin eynslraglg yvhnslsnmq
541 pqvamwryly smgehpstsd qdnsfktddf tfnygwtynk ldrgyfptdg srvnltgkvt
601 ipgsdneyyk vtldtatyvp idddhkwvvl gctrwgygdg lggkempfye nfyaggsstv
661 rgfqsntigp kavyfphqas nydpdydyec atqdgakdlc ksddavggna mtvaslefit
721 ptpfisdkya nsvrtsffwd mgtvwdtnwd ssqysgypdy sdpsnirmsa gialqwmspl
781 gplvfsyaqp fkkydgdkae qfqfnigktw
```

Figure 86

```
  1 mkkriptlla tmiatalysq qglaadlasq cmlgvpsydr plvqgdtndl pvtinadhak
 61 gdypddavft gsvdimqgns rlqadevqlh qkeapgqpep vrtvdalgnv hyddnqvilk
121 gpkgwanlnt kdtnvwegdy qmvgrqgrgk adlmkqrgen rytildngsf tsclpgsdtw
181 svvgseiihd reeqvaeiwn arfkvgpvpi fyspylqlpv gdkrrsgfli pnakytttny
241 fefylpyywn iapnmdatit phymhrrgni mwenefryls qagaglmeld ylpsdkvyed
301 ehpnddssrr wlfywnhsgv mdqvwrfnvd ytkvsdpsyf ndfdnkygss tdgyatqkfs
361 vgyavqnfna tvstkqfqvf seqntssysa epqldvnyyq ndvgpfdtri ygqavhfvnt
421 rddmpeatrv hleptinlpl snnwgsinte akllathyqq tnldwynsrn ttkldesvnr
481 vmpqfkvdgk mvferdmeml apgytqtlep raqylyvpyr dqsdiynyds sllqsdysgl
541 frdrtyggld riasanqvtt gvtsriydda averfnisvg qiyyftesrt gddnitwend
601 dktgslvwag dtywriserw glrggiqydt rldnvatsns sieyrrdedr lvqlnyryas
661 peyiqatlpk yystaeqykn gisqvgavas wpiadrwsiv gayyydtnan kqadsmlgvq
721 yssccyairv gyerklngwd ndkqhavydn aigfnielrg lssnyglgtq emlrsnilpy
781 qntl
```

Figure 87

```
  1 qeptdtpvsh ddtivvtaae qnlqapgvst itadeirknp vardvskiir txpgvnltgn
 61 stsgqrgnnr qidirgxgpe ntlilidgkp vssrnsvrqg wrgerdtrgd tswvppexie
121 rievlrgpaa arygngaagg vvniitkkgs gewhgswday fnapehkeeg atkrtnfslt
181 gplgdefsfr lygnldktqa dawdinqghq saragtyatt lpagregvin kdingvvrwd
241 faplqslele agysrqgnly agdtqntnsd sytrskygde tnrlyrqnya ltwnggwdng
301 vttsnwvqye htrnsripeg laggtegkfn ekatqdfvdi dlddvxlhse vnlpidflvn
361 qtltlgtewn qqrxkdlssn tqaltgtntg gaidgvsttd rspyskaeif slfaennxel
421 tdstivtpgl rfdhhsivgn nwspalnisq glgddftlkx giaraykaps lyqtnpnyil
481 yskgqgcyas aggcylqgnd dlkaetsink eiglefkrdg wlagvtwfrn dyrnkieagy
541 vavgqnavgt dlyqwdnvpk avveglegsl nvpvsetvxn tnnityxlks enkttgdrls
601 iipeytlnst lswqaredls xqttftwygk qqpkkynykg qpavgpetke ispysivgls
661 atwdvtknvs ltggvdnlfd krlwragnaq ttgdlagany iagagaytyn epgrtwyxsv
721 nthf
```

Figure 88

```
  1 mtplrvfrkt tplvntirls llplaglsfs afaaqvniap gsldkalnqy aahsgftlsv
 61 dasltrgkqs nglhgdydve sglqqlldgs glqvkplgnn swtlepapap kedaltvvgd
121 wlgdarendv fehagardvi rredfaktga ttmrevlnri pgvsapenng tgshdlamnf
181 girglnprla srstvlmdgi pvpfapygqp qlslapvslg nmdaidvvrg ggavrygpqs
241 vggvvnfvtr aipqdfgiea gvegqlspts sqnnpkethn lmvggtadng fgtallysgt
301 rgsdwrehsa triddlmlks kyapdevhtf nsllqyydge admpgglsra dydadrwqst
361 rpydrfwgrr klaslgyqfq pdsqhkfniq gfytqtlrsg yleqgkritl sprnywvrgi
421 eprysqifmi gpsahevgvg yrylnesthe mryytatssg qlpsgsspyd rdtrsgteah
481 awylddkidi gnwtitpgmr fehiesyqnn aitgtheevs ynaplpalnv lyhltdswnl
541 yantegsfgt vqysqigkav qsgnvepeka rtwelgtryd dgaltaemgl flinfnnqyd
601 snqtndtvta rgktrhtgle tqarydlgtl tptldnvsiy asyayvnaei rekgdtygnl
661 vpfspkhkgt lgvdykpgnw tfnlnsdfqs sqfadnantv kesadgstgr ipgfmlwgar
721 vaydfgpqma dlnlafgvkn ifdqdyfirs yddnnkgiya gqprtlymqg slkf
```

Figure 89

```
  1 mmiskkytlw alnpllltmm apavaqqtdd etfvvsanrs nrtvaemaqt twvienaele
 61 qqiqggkelk dalaqlipgl dvssrsrtny gmnvrgrplv vlvdgvrlns srtdsrqlds
121 idpfnidrie visgatslyg ggstgglini vtkkgqpeti mefeagtksg fssskdhder
181 iagavsggne hisgrlsvay qkfggwfdgn gdatlldntq tglqysdrld imgtgtlnid
241 esrqlqlitq yyksqgdddy glnlgkgfsa irgtstpfvs nglnsdripg terhlislqy
301 sdsaflgqel vgqvyyrdes lrfypfptvn ankqvtafss sqqdtdqygm kltlnskpmd
361 gwqitwglda dherftsnqm ffdlaqasas gglnnkkiyt tgrypsydit nlaaflqsgy
421 dinnlftlng gvryqytenk iddfigyaqq rqiaagkats adaipggsvd ydnflfnagl
481 lmhiterqqa wlnfsqgvel pdpgkyygrg iygaavnghl pltksvnvsd sklegvkvds
541 yelgwrftgn nlrtqiaayy sisdksvvan kdltisvvdd krriygvega vdylipdtdw
601 stgvnfnvlk teskvngtwq kydvktasps katayigwap dpwslrvqst tsfdvsdaqg
661 ykvdgyttvd llgsyqlpvg tlsfsienlf drdyttvwgq raplyyspgy gpaslydykg
721 rgrtfglnys vlf
```

Figure 90

```
  1 mikkasllta csvtafsawa qdtspdtlvv tanrfeqprs tvlapttvvt rqdidrwqst
 61 svndvlrrlp gvditqnggs gqlssifirg tnashvlvli dgvrlnlagv sgsadlsqfp
121 ialvqrveyi rgprsavygs daiggvvnii ttrdepgtei sagwgsnsyq nydvstqqql
181 gdktrvtllg dyahthgydv vaygntgtqa qtdndgflsk tlygalehnf tdawsgfvrg
241 ygydnrtnyd ayyspgspll dtrklysqsw daglryngel iksqlitsys hskdynydph
301 ygrydssatl demkqytvqw annvivghgs igagvdwqkq tttpgtgyve dgydqrntgi
361 yltglqqvgd ftfegaarsd dnsqfgrhgt wqtsagwefi egyrfiasyg tsykapnlgq
421 lygfygnpnl dpekskqweg afegltagvn wrisgyrndv sdlidyddht lkyynegkar
481 ikgveatanf dtgplthtvs ydyvdarnai tdtpllrrak qqvkyqldwq lydfdwgity
541 qylgtrydkd yssypyqtvk mggvslwdla vaypvtshlt vrgkianlfd kdyetvygyq
601 tagreytlsg sytf
```

Figure 91

```
  1 mkkltvaisa vaasvlmams aqaaeiynkd snkldlygkv nakhyfssnd addgdttyar
 61 lgfkgetqin dqltgfgqwe yefkgnraes qgsskdktrl afaglkfgdy gsidygrnyg
121 vaydigawtd vlpefggdtw tqtdvfmtqr atgvatyrnn dffglvdgln faaqyqgknd
181 rsdfdnyteg ngdgfgfsat yeyegfgiga tyaksdrtdt qvnagkvlpe vfasgknaev
241 waaglkydan niylattyse tqnmtvfadh fvankaqnfe avaqyqfdfg lrpsvaylqs
301 kgkdlgvwgd qdlvkyvdvg atyyfknms tfvdykinll dkndftkalg vstddivavg
361 lvyqf
```

Figure 92

```
  1 mkktaiaiav alagfatvaq aapkdntwyt gaklgwsqyh dtgfinnngp thenqlgaga
 61 fggyqvnpyv gfemgydwlg rmpykgsven gaykaqgvql taklgypitd dldiytrlgg
121 mvwradtksn vygknhdtgv spvfaggvey aitpeiatrl eyqwtnnigd ahtigtrpdn
181 gmlslgvsyr fgqgeaapvv apapapapev qtkhftlksd vlfnfnkatl kpegqaaldq
241 lysqlsnldp kdgsvvvlgy tdrigsdayn qglserraqs vvdyliskgi padkisargm
301 gesnpvtgnt cdnvkqraal idclapdrrv eievkgikdv vtqpqa
```

Figure 93

```
  1 mamkkllias llfssatvyg aegfvvkdih feglqrvavg aallsmpvrt gdtvndedis
 61 ntiralfatg nfedvrvlrd gntllvqvke rptiasitfs gnksvkddml kqnleasgvr
121 vgesldrttl sdiekgledf yysvgkysas vkavvtplpr nrvdlklvfq egvsakiqqi
181 nivgnhafst eelishfqlr devpwwnvvg drkyqkqkla gdletlrsyy ldrgyarfni
241 dstqvsltpd kkgiyitvni tegdqyklsg vqvsgnlagh saeiekltki epgelyngtk
301 vtkmeddikk llgrygyayp rvqsqpeind adktvklrvn vdagnrfyvr kirfegndts
361 kdsvlrremr qmegawlgsd lvdqgkerln rlgffetvdt dtqrvpgspd qvdvvykvke
421 rntgsfnfgi gygtesqvsf qagvqqdnwl gtgysvging tkndyqtyse lsvtnpyftv
481 dgvslggrif yndfeaddad lsdytnksyg tdvtlgfpin eyntlraglg yvhnklsnmq
541 pqiamdryle smgdpdasdf aaddftfnyg wtynkldrgy fptdgsrvnl tgkvtipgsd
601 neyykvsldt atyvpidndh kwvvlgrtrw gygdglggke mpfyenfyag gsstvrgfqs
661 ntigpkavyk ngahtswddd ddyedctqes gcksddavgg namavaslef itptpfisek
721 yansvrtsff wdmgtvwdtn wdpssapsdv pdysdpgnir msagialqwm splgplvfsy
781 aqpfkkydgd kaeqfqfnig ktw
```

COMPOSITIONS PRODUCED USING ENTERIC PATHOGENS AND METHODS OF USE

RELATED APPLICATIONS

This application claims the benefit of U.S. Provisional Application No. 60/504,119, filed Sep. 19, 2003, which is incorporated by reference in its entirety.

SEQUENCE LISTING

The instant application contains a "lengthy" Sequence Listing which has been submitted via CD-R in lieu of a printed paper copy, and is hereby incorporated by reference in its entirety. Said CD-R, recorded on Dec. 28, 2004, are labeled "Copy 1" and "Copy 2", respectively, and each contains only one identical 632 KB file (29334010.APP).

BACKGROUND

The transmission of enteric pathogens to human populations by the consumption of contaminated food and water has become a world wide concern. Surveillance data compiled by the World Health Organization estimate that gastrointestinal infections and their sequelae result in approximately 4 million to 6 million deaths annually. More than 80% of these cases are among children under the age of five with mortality reaching 4 million. The majority of these deaths are in children less than 2 years of age. In the United States, diarrhea is the second most common infectious illness, accounting for one out of every six infectious diseases. In some developing countries, children have more than 12 episodes of diarrhea per year and diarrheal diseases account for 15 to 34 percent of all deaths.

In the United States food/waterborne diseases cause approximately 76 million illnesses, 325,000 hospitalizations, and 5000 deaths each year. More than 90% of the foodborne illnesses of known causes are of microbial origin. Costs associated with medical expenses and losses in productivity associated with microbial agents are estimated to be between $5.6 and $9.4 billion dollars annually. The most commonly recognized food/borne pathogens contributing to gastrointestinal infections have been shown to be bacteria (e.g., *Salmonella* spp., *Escherichia coli*, *Shigella* spp., and *Vibrio* spp.).

The virulence and pathogenesis of enteric pathogens involves both host and pathogen specific factors. Many pathogen-specific virulence determinants contribute to the pathogenesis of these bacteria. The bacterial virulence of these bacteria is the result of many different attributes, which often contribute to different steps in the complicated series of events we recognize as an infection. Infection occurs primarily by the consumption of contaminated water, food or by direct person to person contact. Once ingested the stages of infection common to enteric pathogens can include attachment, colonization, proliferation, tissue damage, invasion and dissemination. Less frequently, enteric pathogens can produce a bacteremic condition inducing reactive arthritis, kidney failure, Guillian-Barre, Reiter syndrome and other extra-intestinal symptoms.

The first host barrier that enteric pathogens must overcome is the mucosal surface. A single epithelial cell layer separates the host from the lumen of the gastrointestinal tract. This barrier and a plethora of other host antimicrobial mechanisms deter commensal, opportunistic and pathogenic microorganisms from establishing infection. Enteric pathogens have evolved some elaborate pathogenic strategies to attach, invade and translocate across the gut epithelium to cause infection. Adherence to mucosal surfaces is a prerequisite of most enteric pathogens to establish infection. In its simplest form adherence or attachment requires two factors: a receptor and an adhesin. A number of specialized structures (adhesins) have been identified in enteric pathogens that enhance intestinal colonization of the organism. These specialized structures (e.g., pili or fimbriae) act as ligands to bind the bacterial cell to specific complex carbohydrate receptors on the epithelial cell surface of the intestine. Once colonization is established enteric pathogens have a multitude of virulence factors that enhance the ability of the pathogen to invade its host. One of the more pronounced clinical manifestations of intestinal colonization is diarrhea. This clinical syndrome is typically induced by the synthesis and excretion of a variety of enterotoxins, (e.g., heat-labile toxin (LT), heat-stable toxin (ST) cholera toxin (CT) and shiga toxin (Stx)) that cause a net secretion of fluid and electrolytes (diarrhea). Many other specific virulence factors of enteric pathogens have been described that affect a wide range of eukaryotic cell processes in the host, to including invasion of specific cell types, cell to cell interactions and signal transduction by integrins, attaching and effacing with destruction of the epithelial surface, elaboration of exotoxins, and actin polymerization enhancing cell to cell spread, etc.

The diversity of enteric pathogens and virulence factors has complicated the development of new and improved vaccines with long lasting protection. The search for a better vaccine is prompted by the results of epidemiological and challenge studies showing that the recovery from natural infection is often followed by long lasting immunity while providing cross-protection against multiple strains and/or serotypes.

Current vaccines under development for such enteric pathogens as *Vibrio cholera*, *Escherichia coli*, *Salmonella*, and *Shigella* are based on parenteral and oral vaccines. Moderately effective vaccines have been tested and implemented for controlling cholera. The oral vaccines currently under development include two types: killed *Vibrio cholera* bacteria that are combined with purified cholera B subunit toxin, and live-attenuated strains of *V. cholera* with known genetic deletions (Butterton et al., Infect. Immun. 65: 2127-2135 (1997)). Field trials sponsored by The World Health Organization using an oral vaccine consisting of a whole-cell B subunit reported levels of only 50% protection in human populations in underdeveloped countries. The vaccine required multiple doses over a four month period; unfortunately, young children were not well protected (Sack et al. Infect. Immun. 66:1968-1972 (1998); Sanchez et al, Lancet. 349: 1825-1830 (1997); and Trach et al. Lancet. 349: 231-235 (1997)). A whole-cell vaccine containing four common isolates of *V. choleraa* not containing B subunit toxin has also been tested in human subjects that showed a protective efficacy of 65% (Taylor et al. Infect. Immun. 65: 3852-3856 (1997)). A whole-cell vaccine containing four common isolates of cholera not containing B subunit toxin has also been tested in human subjects (Taylor et al. Infect. Immun. 65: 3852-3856 (1997)). The vaccine required two administrations 7-14 days apart and induced a protective index of approximately 65%. However, the vaccine was not well tolerated due to its reactive nature upon injection. Several live-attenuated vaccine candidates have been tested in large scale efficacy trials involving more than 60,000 human subjects. Unfortunately, the results of this pivotal trial did not demonstrate the effectiveness of the vaccine in preventing cholera. Further development in live attenuated gene deleted vaccines has recently shown promise against the O1 and O139 serotypes in human volunteers. However, efficacy of the vaccine in large populations and protection against multiple serotypes have yet to be demonstrated.

There are five categories of diarrheagenic *Escherichia coli* that cause foodborne and waterborne diseases in humans: the enteropathogenic (EPEC), enterohemorrhagic (EHEC), enterotoxigenic (ETEC), enteroinvasive (EIEC) and enteroaggregative (EAEC) strains. The mechanism of disease associated with these pathogens depends on specific characteristics which involve attaching and effacing adherence of the organism to intestinal epithelial cells and damage to the intestinal microvilli. Of particular interest has been the emergence of the Shiga toxin-producing *E. coli*, also referred to as EHEC, primarily of the O157:H7 serotype. This strain of *E. coli* has been shown to synthesize either one or both of the Shiga toxins (Stx-1 and/or Stx-2). This strain has been associated with gastrointestinal infections that begin with diarrhea that can exasperate into hemorrhagic colitis, followed by hemolytic-uremic syndrome (HUS) and/or encephalopathy, particularly in the young, immunocompromized, and elderly adults. The Shiga toxin (Stx) produced by this isolate is believed to be important in the pathogenesis of this organism. Current efforts at vaccine development are primarily focused on animals known to asymptomatically carry these organisms and shed them in their feces. Research has focused on a number of strategies for controlling this organism, which revolve around the concept of preventing colonization by targeting the colonization factor intimin, and immunization of animals with genetically modified non-toxin producing versions of the parent isolate. The intimin protein has been shown to be responsible for the attaching and effacing lesions also characteristic of both *Shigella dysenteriae* (STEC) and the enteropathogenic (EPEC) strains of *E. coli*. In addition, researchers have been investigating the expression of intimin in animal feed products such as canola and alfalfa for use as an edible animal vaccine. If any of these strategies work in animals it could find its way to human usage (Acheson et al. Infect. Immun. 64: 355-357 (1996); Bokete et al. J. Infect. Dis. 175: 1382-1389 (1997); Bosworth et al. Infect. Immun. 64:55-60 (1996) and Konadu et al. Infect. Immun. 62: 5048-5054 (1994)).

The National Institute of Child Health and Human development have proposed the use of conjugate vaccines using the B-subunit of Stx-1 in conjunction with a whole cell as developed for *V. cholerae*, which has shown promising results in experimental animal models as well as toxoids and immunotherapeutics using antitoxin antibodies as well as human monoclonal antibodies to neutralize the Stx-1 and Stx-2 toxin. Such prophylactic and immunotherapeutic strategies could protect against STEC infection as well as infections caused by closely related organisms such as EPEC and EHEC strains of *E. coli*.

Enterotoxigenic (ETEC) strains of *E. coli* are an important cause of diarrhea in infants in less developed countries. It is estimated that ETEC causes more than 650 million cases of diarrhea per year and more than 800,000 deaths in children less than 5 years of age. ETEC is also the major cause of traveler's diarrhea, which affects at least 8 million United States citizens who travel to endemic regions of the world each year. Virulence factors associated with these strains of *E. coli* include primarily adhesins and enterotoxins such as LT1, STa and STb. In volunteer studies infection with ETEC generates protective immunity against rechallenge with the same strain. The vaccine candidate currently being developed consists of a mixture of five formalin-inactivated ETEC strains, which together express the required adhesins, combined with a recombinant Cholera toxin B subunit, which generates antibody that cross-reacts with the ETEC-LT toxin. Clinical studies have shown that the vaccine is immunogenic and safe in human volunteers.

*Shigella* spp. such as *S. sonnei, S. flexneri, S. boydii* and *S. dysenteriae* are causative agents of shigellosis or bacillary dysentery. In the United States approximately 13,000 cases of shigellosis were reported in 2002, a 22% increase from 2001 (CDC, *Shigella* Annual Summary 2002). Nearly 30% of the reported cases occurred in children under the age of five. The mechanism of disease associated with these pathogens is characterized by specific attaching and effacing lesions involving microvilli destruction, and the production of potent exotoxins (Shiga toxin) that frequently results in hemolytic uremic syndrome. A virulence plasmid present in all invasive *Shigella* strains has been identified that encode a number of outer membrane proteins that mediate attachment to the epithelial cell. Several of the plasmid-encoded proteins initiate parasite-induced phagocytosis which in turn breaks down the membrane of the phagocytic vacuole, allowing bacteria to multiply within the cytoplasm.

Vaccine strategies created to control shigellosis have focused on attenuated strains with known genetic deletions. A deletion mutant of *S. flexneri* has shown excellent protection after a single oral dose. This vaccine candidate provides protection against severe shigellosis in volunteers challenged with *S. flexneri*. Other vaccine strategies include the development of auxotrophic mutants and recent studies have shown protection using O-specific polysaccharides conjugates from *S. sonnei* and *S. flexneri*. As with many of these diseases a comprehensive vaccine approach to controlling shigellosis must include various bacterial components to protect against the multiple serotypes of *Shigella* that are responsible for endemic outbreaks of dysentery (Ashkenazi et al., J. Infect. Immun. 179: 1565-1568 (1999); Cohen et al., Lancet. 349: 155-159 (1997); Coster et al., Infect. Immun. 67: 3437-3437 (1999); Kotloff et al., infect Immun. 64: 4542-4548 (1996) and Sansonetti et al., Res. Immunol. 147:595-602 (1996)).

*Salmonella* infections are the leading cause of bacterial foodborne diseases worldwide and are one of the most common enteric diseases in the United States. There are approximately 2,213 different *Salmonella* strains currently identified which can be classified according to their adaptation to human and animal hosts. For instance, *S. typhi* and *S. paratyphi* causes enteric or typhoid fever only in humans and globally infect 20-30 million people annually and cause 600,000 deaths. In the United States, more than 41,000 cases were reported in 1993 with the highest incidence being in children 5 to 19 years of age. Non-typhoidal *Salmonella enterica* is one of the most common causes of food poisoning in the United States, responsible for an estimated 1.4 million cases of salmonellosis annually (Mead et al. Emerg. Infect. Dis. 5:607-625 (1999)). The cost of human salmonellosis in the U.S. is estimated to be several billion dollars annually based on healthcare costs and lost productivity.

There has been a number of virulence factors associated with disease caused by *Salmonella*. Briefly, the pathogenesis of the organism begins with the colonization of the host followed by localized degeneration of the epithelial surface resulting in penetration of the epithelial barrier and proliferation in the lamina propria, multiplication, and stimulation of an inflammatory response. Diarrhea associated with salmonellosis is associated primarily with the inflammatory response, which stimulates the release of prostaglandins and production of cAMP, which increase the secretion of fluid and electrolytes into the lumen of the bowel (diarrhea).

A number of parenteral whole-cell vaccines for typhoid fever have been developed but have been found to be only marginally effective because of severe adverse reactions in vaccinates. Currently the National Institute of Child Health and Human Development has developed and tested a vaccine consisting of the Vi antigen. Clinical trials have demonstrated an efficacy of 72-80% with a single injection. A number of gene deleted mutants have been developed for controlling *S. typhi* with varying degrees of success (Germanier et al. J. Infect. Dis 131:553-558 (1975); Hohmann et al. J. Infect. Dis. 173:1408-1414 (1996); Nardelli-Haefliger et al. Infect. Immun. 64:5219-5224 (1996); Stocker Vaccine. 6:141-145 (1988); Szu et al. Infect. Immun. 62: 4440-4444 (1994); Tacket et al. Infect Immun. 60: 536-541 (1992); and Tacket et al. Vaccine. 10: 443-446 (1992)).

The remaining *Salmonella* strains commonly referred to as nontyphoidal are primarily transmitted from animals to humans (Calnek et al., Diseases of Poultry-9$^{th}$ ed., pp. 99-130, Iowa StateUniversity, Ames Iowa (1991)). In the United States, the most common serotypes of *S. enterica* isolated from humans are serotypes Typhimurium, Enteritidis, and Newport (CDC *Salmonella* Annual Summary, 2002). These three serotypes accounted for 51% of human *Salmonella* isolates in 2002. Notably, the serotypes Typhimurium and Newport are frequently resistant to multiple antibiotics. In a 2001 annual survey, 53% of Typhimurium isolates were resistant to at least one antibiotic and 30% were resistant to five antibiotics in a manner characteristic of the DT104 phage type (CDC National Antimicrobial Resistance Monitoring System: Enteric Bacteria, available on the world wide web at cdc.gov/narms/). In addition, 26% of Newport isolates were resistant to at least nine antibiotics in the 2001 annual survey. The Typhimurium and Newport serotypes are primarily associated with the consumption of a variety of different types of animal products that become contaminated during processing or handling. In contrast, *Salmonella* serotype Enteritidis is almost exclusively associated with the consumption of contaminated chicken eggs. This serotype has a propensity to colonize poultry ovarian tissues for extended periods of time (Okamura et al., Avian Dis., 45: 61-69 (2001) and Okamura et al., Avian Dis., 45: 962-971 (2001)), and can gain entry to the egg environment by vertical transmission during egg formation (Gast et al., Avian Dis. 44: 706-710 (2000) and Humphrey et al., Int. J. Food Microbiol. 21: 31-40 (1994)). A recent risk assessment estimated that 2.3 million eggs are contaminated in the United States annually, resulting in approximately 660,000 human infections (Hope et al., Risk Anal., 22:203-218 (2002)). Additional serotypes that have been associated with human salmonellosis derived from poultry and other animals include *S. enterica* Heidelberg, Hadar, Infantis, Agona, Montevideo, Thompson, and Braenderup.

Research for controlling nontyphoidal *Salmonella* has been primarily limited to the bacterins, which consist of killed *Salmonella* cells, and the live attenuated strains of *Salmonella*. Bacterins typically stimulate antibody responses in vaccinated animals but may be limited in their ability to promote cell-mediated immunity (Babu et al., Vet. Immunol. Immunopathol. 91:39-44 (2003) and Okamura et al., Comp. Immunol. Microbiol. Infect. Dis. 27:255-272 (2004)), an important host response for effective clearance of *Salmonella* (Lalmanach and Lantier. Microbes Infect. 1:719-726 (1999) and Naiki et al., J. Immunol. 163:2057-2063 (1999)). In addition, bacterins have generally produced inconsistent protection against fecal shedding of *Salmonella* (House et al., Am. J. Vet. Res. 12: 1897-1902 (2001) and Davison et al., Avian Dis. 43:664-669 (1999)). Other disadvantages of bacterins include injection-site granulomas, weight loss, and serotype-specific protection. The live attenuated *Salmonella* vaccines are generally considered to provide better cross-protection than observed with the bacterins (Hassan and Curtiss, III. Infect. Immun. 62:5519-5527. (1994)), and additionally stimulate both humoral and cell-mediated immune responses (Curtiss, III et al., Vet Microbiol. 37:397-405 (1993) and Villarreal-Ramos et al., Vaccine 16: 45-54 (1998)). However, there are significant obstacles regarding the safety of introducing these organisms into commercial animals; specifically, there is concern that genetic reversion will occur and render the vaccine strain virulent. A second potential problem with using modified live vaccines is that antibodies generated to the somatic antigen of the vaccination strains can interfere with national and state *Salmonella* monitoring programs by generating false positive reactions. In addition, antibiotics are often administered in commercial flocks to control infection rates which can eliminate the attenuated vaccine strain; hence, repeated immunizations of live *Salmonella* vaccines are often required. There have been relatively few attempts to formulate subcellular vaccines for controlling *Salmonella* in agricultural animals. A few key studies in poultry species utilized crude cell extracts in their vaccinations, showing S. Enteritidis-specific mucosal and/or circulating antibody responses (Fukutome et al., Dev. Comp. Immunol. 25:475-484 (2001) and Ochoa-Reparaz et al., Vet. Res. 35:291-298 (2004)). In other studies, purified outer membrane protein compositions were demonstrated to promote heightened antibody responses and reduced intestinal colonization or fecal shedding following challenge with S. Enteritidis (Charles et al., Am. J. Vet. Res. 55:636-642 (1994), Khan et al., J. Appl. Microbiol. 95:142-145 (2003), and Meenakshi et al., Vet. Res. Commun. 23:81-90 (1999)).

SUMMARY

The present invention provides compositions including a polypeptide having the characteristics of a polypeptide expressed by a reference microbe. The characteristics of the polypeptide include both molecular weight and mass fingerprint. The reference microbe may be, for instance, an *E. coli* or a *Salmonella*. Examples of *Salmonella* strains that can be used include, for instance, *S. enterica* serovar Newport, *S. enterica* serovar Enteritidis, *S. enterica* serovar Typhimurium, and *S. enterica* serovar Dublin. Preferably, the reference polypeptide is expressed by the microbe during growth in low metal conditions. The present invention also provides compositions including a polypeptide having a particular molecular weight and a mass fingerprint that includes polypeptide fragments having a particular set of masses. The present invention further provides compositions including a polypeptide having an amino acid sequence with at least about 95% identity with a reference amino acid sequence, wherein the polypeptide has seroreactive activity.

The compositions of the present invention may optionally include a pharmaceutically acceptable carrier. The present invention also includes methods for using the polypeptides disclosed herein. Methods include inducing the production of antibody in an animal, treating a gram negative microbial infection in an animal, and decreasing intestinal colonization of an animal.

BRIEF DESCRIPTION OF THE FIGURES

FIG. 12. Amino acid sequence of SEQ ID NO:1367.
FIG. 13. Amino acid sequence of SEQ ID NO:1368.
FIG. 14. Amino acid sequence of SEQ ID NO:1369.
FIG. 15. Amino acid sequence of SEQ ID NO:1370.
FIG. 16. Amino acid sequence of SEQ ID NO:1371.
FIG. 17. Amino acid sequence of SEQ ID NO:1372.
FIG. 18. Amino acid sequence of SEQ ID NO:1373.
FIG. 19. Amino acid sequence of SEQ ID NO:1374.
FIG. 20. Amino acid sequence of SEQ ID NO:1375.
FIG. 21. Amino acid sequence of SEQ ID NO:1376.
FIG. 22. Amino acid sequence of SEQ ID NO:1377.
FIG. 23. Amino acid sequence of SEQ ID NO:1378.
FIG. 24. Amino acid sequence of SEQ ID NO:1379.
FIG. 25. Amino acid sequence of SEQ ID NO:1380.
FIG. 26. Nucleotide sequence of SEQ ID NO:1382.
FIG. 27. Nucleotide sequence of SEQ ID NO:1383.
FIG. 28. Nucleotide sequence of SEQ ID NO:1384.
FIG. 29. Nucleotide sequence of SEQ ID NO:1385.
FIG. 30. Nucleotide sequence of SEQ ID NO:1386.
FIG. 31. Nucleotide sequence of SEQ ID NO:1387.
FIG. 32. Nucleotide sequence of SEQ ID NO:1388.
FIG. 33. Nucleotide sequence of SEQ ID NO:1389.
FIG. 34. Nucleotide sequence of SEQ ID NO:1390.
FIG. 35. Nucleotide sequence of SEQ ID NO:1391.
FIG. 36. Nucleotide sequence of SEQ ID NO:1392.
FIG. 37. Nucleotide sequence of SEQ ID NO:1393.
FIG. 38. Nucleotide sequence of SEQ ID NO:1394.
FIG. 39. Nucleotide sequence of SEQ ID NO:1395.
FIG. 40. Nucleotide sequence of SEQ ID NO:1396.
FIG. 41. Nucleotide sequence of SEQ ID NO:1397.
FIG. 42. Nucleotide sequence of SEQ ID NO:1398.
FIG. 43. Nucleotide sequence of SEQ ID NO:1399.
FIG. 44. Nucleotide sequence of SEQ ID NO:1400.
FIG. 45. Nucleotide sequence of SEQ ID NO:1401.
FIG. 46. Nucleotide sequence of SEQ ID NO:1402.
FIG. 47. Nucleotide sequence of SEQ ID NO:1403.
FIG. 48. Nucleotide sequence of SEQ ID NO:1404.
FIG. 49. Nucleotide sequence of SEQ ID NO:1405.
FIG. 50. Nucleotide sequence of SEQ ID NO:1406.
FIG. 51. Nucleotide sequence of SEQ ID NO:1407.
FIG. 52. Nucleotide sequence of SEQ ID NO:1408.
FIG. 53. Nucleotide sequence of SEQ ID NO:1409.
FIG. 54. Nucleotide sequence of SEQ ID NO:1410.
FIG. 55. Nucleotide sequence of SEQ ID NO:1411.
FIG. 56. Nucleotide sequence of SEQ ID NO:1412.
FIG. 57. Nucleotide sequence of SEQ ID NO:1413.
FIG. 58. Nucleotide sequence of SEQ ID NO:1414.
FIG. 59. Nucleotide sequence of SEQ ID NO:1415.
FIG. 60. Nucleotide sequence of SEQ ID NO:1416.
FIG. 61. Nucleotide sequence of SEQ ID NO:1417.
FIG. 62. Nucleotide sequence of SEQ ID NO:1418.
FIG. 63. Nucleotide sequence of SEQ ID NO:1419.
FIG. 64. Nucleotide sequence of SEQ ID NO:1420.
FIG. 65. Nucleotide sequence of SEQ ID NO:1421.
FIG. 66. Nucleotide sequence of SEQ ID NO:1422.
FIG. 67. Nucleotide sequence of SEQ ID NO:1423.
FIG. 68. Nucleotide sequence of SEQ ID NO:1424.
FIG. 69. Nucleotide sequence of SEQ ID NO:1425.
FIG. 70. Nucleotide sequence of SEQ ID NO:1426.
FIG. 71. Nucleotide sequence of SEQ ID NO:1427.
FIG. 72. Nucleotide sequence of SEQ ID NO:1428.
FIG. 73. Nucleotide sequence of SEQ ID NO:1429.
FIG. 74. Nucleotide sequence of SEQ ID NO:1430.
FIG. 75. Nucleotide sequence of SEQ ID NO:1431.
FIG. 76. Nucleotide sequence of SEQ ID NO:1432.
FIG. 77. Nucleotide sequence of SEQ ID NO:1433.
FIG. 78. Nucleotide sequence of SEQ ID NO:1434.
FIG. 79. Nucleotide sequence of SEQ ID NO:1435.
FIG. 80. Nucleotide sequence of SEQ ID NO:1436.
FIG. 81. Nucleotide sequence of SEQ ID NO:1437.
FIG. 82. Nucleotide sequence of SEQ ID NO:1438.
FIG. 83. Nucleotide sequence of SEQ ID NO:1439.
FIG. 84. Nucleotide sequence of SEQ ID NO:1440.
FIG. 85. Nucleotide sequence of SEQ ID NO:1441.
FIG. 86. Nucleotide sequence of SEQ ID NO:1442.
FIG. 87. Nucleotide sequence of SEQ ID NO:1443.
FIG. 88. Nucleotide sequence of SEQ ID NO:1444.
FIG. 89. Nucleotide sequence of SEQ ID NO:1445.
FIG. 90. Nucleotide sequence of SEQ ID NO:1446.
FIG. 91. Nucleotide sequence of SEQ ID NO:1447.
FIG. 92. Nucleotide sequence of SEQ ID NO:1448.
FIG. 93. Nucleotide sequence of SEQ ID NO:1381.

DETAILED DESCRIPTION OF PREFERRED EMBODIMENTS OF THE INVENTION

Figure 1:
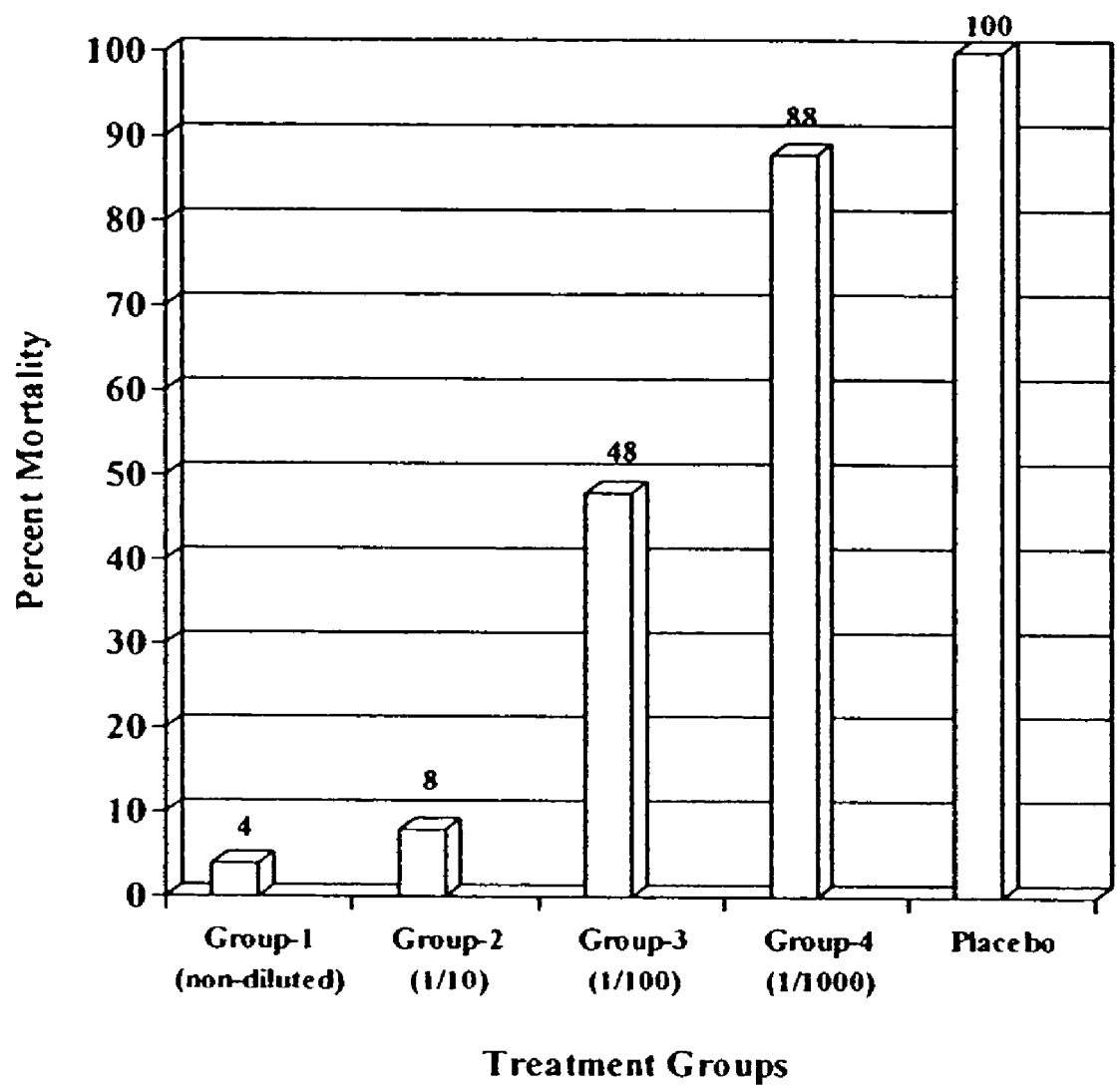
FIG. 1. The percent mortality in mice showing a dose response to varying concentrations of a composition prepared from *Salmonella enterica* serovar Newport after challenge. Non-diluted, 1/10, 1/100, and 1/1000 refer to the dilution of the stock vaccine as described in Example 5. Numbers above the bars indicate the percent mortality.

The present invention provides polypeptides and compositions including polypeptides. As used herein, "polypeptide" refers to a polymer of amino acids linked by peptide bonds. Thus, for example, the terms peptide, oligopeptide, protein, and enzyme are included within the definition of polypeptide. This term also includes post-expression modifications of the polypeptide, for example, glycosylations, acetylations, phosphorylations, and the like. The term polypeptide does not connote a specific length of a polymer of amino acids. A polypeptide may be obtainable directly from a natural source, or can be prepared with the aid of recombinant, enzymatic, or chemical techniques. In the case of a polypeptide that is naturally occurring, such polypeptide is typically isolated. An "isolated" polypeptide is one that has been removed from its natural environment. For instance, an isolated polypeptide is a polypeptide that has been removed from the cytoplasm or from the outer membrane of a cell, and many of the polypeptides, nucleic acids, and other cellular material of its natural environment are no longer present. A "purified" polypeptide is one that is at least 60% free, preferably 75% free, and most preferably 90% free from other components with which they are naturally associated. Polypeptides that are produced outside the organism in which they naturally occur, e.g., through chemical or recombinant means, are considered to be isolated and purified by definition, since they were never present in a natural environment. As used herein, a "polypeptide fragment" refers to a portion of a polypeptide that results from digestion of a polypeptide with a protease. Unless otherwise specified, "a," "an," "the," and "at least one" are used interchangeably and mean one or more than one.

A polypeptide of the present invention may be characterized by molecular weight. The molecular weight of a polypeptide, typically expressed in kilodaltons (kDa), can be determined using routine methods including, for instance, gel filtration, gel electrophoresis including sodium dodecyl sulfate (SDS) polyacrylamide gel electrophoresis, capillary electrophoresis, mass spectrometry, and liquid chromatography including HPLC.

A polypeptide of the present invention may be characterized by mass fingerprint. As used herein, a "mass fingerprint" refers to a population of polypeptide fragments obtained from a polypeptide after digestion with a protease. Typically, the polypeptide fragments resulting from a digestion are analyzed using a mass spectrometric method. Each polypeptide fragment is characterized by a mass, or by a mass (m) to charge (z) ratio, which is referred to as an "m/z ratio" or an "m/z value". Methods for generating a mass fingerprint of a polypeptide are routine. An example of such a method is disclosed in Example 25.

The polypeptides of the present invention may be metal regulated polypeptides. As used herein, a "metal regulated polypeptide" is a polypeptide that is expressed by a microbe at a greater level when the microbe is grown in low metal conditions compared to growth of the same microbe in high metal conditions. Low metal and high metal conditions are described herein. For instance, a metal regulated polypeptide is not expressed at detectable levels during growth of the microbe in high metal conditions but is expressed at detectable levels during growth in low metal conditions. Another type of metal regulated polypeptide is expressed at detectable levels during growth of the microbe in high metal conditions but expressed at higher levels during growth in low metal conditions. The expression of such polypeptides is referred to herein as "enhanced" during growth in low metal conditions. In general, metal regulated polypeptides typically have a molecular weight of 66 kDa or greater. Polypeptides that are not metal regulated are typically expressed at about the same level when the microbe is grown in low metal and high metal conditions. In general, non-metal regulated polypeptides typically have a molecular weight of less than 66 kDa.

Whether a metal regulated polypeptide is expressed at a detectable level or has enhanced expression during growth in low metal conditions can be determined by methods useful for comparing the presence of polypeptides, including, for example, gel filtration, gel electrophoresis including sodium dodecyl sulfate (SDS) polyacrylamide gel electrophoresis, capillary electrophoresis, mass spectrometry, and liquid chromatography including HPLC. Separate cultures of a microbe are grown under high metal conditions and under low metal conditions, polypeptides of the present invention are isolated as described herein, and the polypeptides present in each culture are resolved and compared. Typically, an equal amount of polypeptide from each culture is used. For instance, when SDS polyacrylamide gel electrophoresis is used to compare the polypeptides, about 30 μg micrograms of polypeptide from each culture is used and loaded into a well. After running the gel and staining the polypeptides, the two lanes can be compared.

Preferably, polypeptides of the present invention have immunogenic activity. "Immunogenic activity" refers to the ability of a polypeptide to elicit an immunological response in an animal. An immunological response to a polypeptide is the development in an animal of a cellular and/or antibody-mediated immune response to the polypeptide. Usually, an immunological response includes but is not limited to one or more of the following effects: the production of antibodies, B cells, helper T cells, suppressor T cells, and/or cytotoxic T cells, directed to an epitope or epitopes of the polypeptide. "Epitope" refers to the site on an antigen to which specific B cells and/or T cells respond so that antibody is produced.

In one aspect, a polypeptide of the present invention has the characteristics of a polypeptide expressed by a reference microbe. The characteristics include both molecular weight and mass fingerprint. The reference microbe can be *Salmonella* or an *E. coli*. Preferred examples of each of these are detailed in Table 1.

TABLE 1

Bacterial strains.

| Bacterial cell | Laboratory designation |
| --- | --- |
| *S. enterica* serovar Newport | MS020508 (Accession No. PTA-9496, American Type Culture Collection, Manassas, VA, deposited Sep. 16, 2008) |
| *S. enterica* serovar Enteritidis | MS010531 |
| *S. enterica* serovar Typhimurium | MS010427 |
| *S. enterica* serovar Dublin | IRP SDC Serial |
| *E. coli* | BEcO157(stx-), MS040330, MS040324, or MS040827 |

When the reference microbe is *S. enterica* serovar Newport, for instance MS020508 (ATCC Accession No. PTA-9496), a candidate polypeptide is considered to be a polypeptide of the present invention if it has a molecular weight of 82 kDa, 80 kDa, 74 kDa, 65 kDa, 56 kDa, 55 kDa, 52 kDa, 45 kDa, 38 kDa, 36 kDa, 22 kDa, 18 kDa, or 12 kDa, and has a mass fingerprint that is similar to the mass fingerprint of a polypeptide expressed by a reference microbe and having a molecular weight of 80 kDa, 74 kDa, 65 kDa, 56 kDa, 55 kDa, 52 kDa, 45 kDa, 38 kDa, 36 kDa, 22 kDa, 18 kDa, or 12 kDa, respectively.

When the reference microbe is *S. enterica* serovar Enteritidis, for instance MS010531, a polypeptide is considered to be a polypeptide of the present invention if it has a molecular weight of 92 kDa, 91 kDa, 86 kDa, 83 kDa, 78 kDa, 55 kDa, 40 kDa, 39 kDa, or 38 kDa, and has a mass fingerprint that is similar to the mass fingerprint of a polypeptide expressed by a reference microbe and having a molecular weight of 92 kDa, 91 kDa, 86 kDa, 83 kDa, 78 kDa, 55 kDa, 40 kDa, 39 kDa, or 38 kDa, respectively.

When the reference microbe is *S. enterica* serovar Typhimurium, for instance MS010427, a polypeptide is considered to be a polypeptide of the present invention if it has a molecular weight of 86 kDa, 82 kDa, 77 kDa, 40 kDa, 39 kDa, or 38 kDa, and has a mass fingerprint that is similar to the mass fingerprint of a polypeptide expressed by a reference microbe and having a molecular weight of 86 kDa, 82 kDa, 77 kDa, 40 kDa, 39 kDa, or 38 kDa, respectively.

When the reference microbe is *S. enterica* serovar Dublin, for instance IRP SDC Serial, a polypeptide is considered to be a polypeptide of the present invention if it has a molecular weight of 96 kDa kDa, 89 kDa, 81 kDa, 61 kDa, 56 kDa, 51 kDa, 43 kDa, 40 kDa, or 38 kDa, and has a mass fingerprint that is similar to the mass fingerprint of a polypeptide expressed by a reference microbe and having a molecular weight of 96 kDa kDa, 89 kDa, 81 kDa, 61 kDa, 56 kDa, 51 kDa, 43 kDa, 40 kDa, or 38 kDa, respectively.

When the reference microbe is an *E. coli*, for instance BEcO157(stx−), a polypeptide is considered to be a polypeptide of the present invention if it has a molecular weight of 90 kDa, 86 kDa, 83 kDa, 79 kDa, 66 kDa, 56 kDa, 38 kDa, 37 kDa, or 29 kDa, and has a mass fingerprint that is similar to the mass fingerprint of a polypeptide expressed by a reference microbe and having a molecular weight of 90 kDa, 86 kDa, 83 kDa, 79 kDa, 66 kDa, 56 kDa, 38 kDa, 37 kDa, or 29 kDa, respectively.

When the reference microbe is an *E. coli*, for instance MS040330, a polypeptide is considered to be a polypeptide of the present invention if it has a molecular weight of 92 kDa, 80 kDa, 77 kDa, 72 kDa, 66 kDa, 50 kDa, 42 kDa, 38 kDa, 36 kDa, 35 kDa, 30 kDa, 19 kDa, or 16 kDa, and has a mass fingerprint that is similar to the mass fingerprint of a polypeptide expressed by a reference microbe and having a molecular weight of 92 kDa, 80 kDa, 77 kDa, 72 kDa, 66 kDa, 50 kDa, 42 kDa, 38 kDa, 36 kDa, 35 kDa, 30 kDa, 19 kDa, or 16 kDa, respectively.

When the reference microbe is an *E. coli*, for instance MS040324, a polypeptide is considered to be a polypeptide of the present invention if it has a molecular weight of 88 kDa, 82 kDa, 79 kDa, 60 kDa, 54 kDa, 46 kDa, 45 kDa, 38 kDa, 37 kDa, 31 kDa, 30 kDa, 19 kDa, 16 kDa, and has a mass fingerprint that is similar to the mass fingerprint of a polypeptide expressed by a reference microbe and having a molecular weight of 88 kDa, 82 kDa, 79 kDa, 60 kDa, 54 kDa, 46 kDa, 45 kDa, 38 kDa, 37 kDa, 31 kDa, 30 kDa, 19 kDa, 16 kDa, respectively.

When the reference microbe is an *E. coli*, for instance MS040827, a polypeptide is considered to be a polypeptide of the present invention if it has a molecular weight of 101 kDa, 88 kDa, 85 kDa, 77 kDa, 67 kDa, 38 kDa, 35 kDa, and has a mass fingerprint that is similar to the mass fingerprint of a polypeptide expressed by a reference microbe and having a molecular weight of 101 kDa, 88 kDa, 85 kDa, 77 kDa, 67 kDa, 38 kDa, 35 kDa, respectively.

The polypeptides expressed by a reference microbe and referred to above by molecular weight can be obtained by growth of the reference microbe under low metal conditions and the subsequent isolation of a polypeptide by the processes disclosed herein. A candidate polypeptide can be obtainable from a microbe, preferably a gram negative microbe, more preferably, a member of the family Enterobacteriaceae, for instance, a member of the tribe Escherichieae or Salmonelleae. A candidate polypeptide may also be produced using recombinant, enzymatic, or chemical techniques.

A candidate polypeptide may be evaluated by mass spectrometric analysis to determine whether the candidate polypeptide has a mass fingerprint similar to one of the polypeptides expressed by a reference microbe and referred to above by molecular weight. Typically, the candidate polypeptide is purified, for instance by resolving the candidate polypeptide by gel electrophoresis and excising the portion of the gel containing the candidate polypeptide. Any gel electrophoresis method that separates polypeptides based on differing characteristics can be used, including 1 dimensional or 2 dimensional gel electrophoresis, as well as separation based on, for instance, hydrophobicity, pI, or size. The candidate polypeptide is fragmented, for instance by digestion with a protease. Preferably, the protease cleaves the peptide bond on the carboxy-terminal side of the amino acid lysine and the amino acid arginine, except when the amino acid following the lysine or the arginine is a proline. An example of such a protease is trypsin. Methods for digesting a polypeptide with trypsin are routine and known to the art. An example of such a method is disclosed in Example 24.

Methods for the mass spectrometric analysis of polypeptides are routine and known to the art and include, but are not limited to, matrix assisted laser desorption/ionization time of flight mass spectroscopy (MALDI-TOF MS). Typically, a mixture containing the polypeptide fragments obtained from a candidate polypeptide is mixed with a matrix that functions to transform the laser energy to the sample and produce ionized, preferably monoisotopic, polypeptide fragments. Examples of matrices that can be used include, for instance, sinapinic acid and cyano-4-hydroxycinnamic acid. An example of a method for the analysis of polypeptides by MALDI-TOF MS is described in Example 24. The ionized polypeptide fragments are separated according to their m/z ratio, and detected to yield a spectrum of m/z ratio versus intensity. The spectrum includes m/z values that represent the polypeptide fragments derived from the candidate polypeptide. For any given polypeptide, the amount of each polypeptide fragment resulting from a trypsin digestion should be equimolar. However, it is known that trypsin digestion is not 100% efficient, for instance, some sites are more efficiently cleaved. Thus, when MALDI-TOF MS is used to determine m/z values, the intensity of each m/z value is typically not identical. Generally, a spectrum has a background level of noise present across most of the x-axis (i.e., the axis having the values of the m/z ratios). This background level of noise varies depending on the running conditions and the machine used, and is easily identified by visual inspection of the spectrum. An m/z value is generally considered to represent a polypeptide fragment when the intensity is at least 2 times greater, 3 times greater, or 4 times greater than the background level of noise. The spectrum usually includes other m/z values that are artifacts resulting from, for instance, incomplete digestion, over digestion, other polypeptides that may be present in the mixture, or the protease used to digest the polypeptide including m/z values resulting from autolysis of the protease. This method of digesting a polypeptide with a protease is recognized by the art as resulting in a mass fingerprint of great specificity that can be used to accurately characterize the polypeptide and distinguish it from other polypeptides.

In this aspect of the invention, when a candidate polypeptide is analyzed by mass spectroscopy, preferably both the candidate polypeptide and the polypeptide from the reference microbe are prepared and analyzed together, thereby decreasing any potential artifacts resulting from differences in sample handling and running conditions. Preferably, all reagents used to prepare and analyze the two polypeptides are the same. For instance, the polypeptide from the reference microbe and the candidate polypeptide are isolated under substantially the same conditions, fragmented under substantially the same conditions, and analyzed by MALDI-TOF MS on the same machine under substantially the same conditions. A mass fingerprint of a candidate polypeptide is considered to be similar to the mass fingerprint of a polypeptide from a reference microbe when 80%, 90%, 95%, or substantially all of the m/z values present in the spectrum of the reference microbe polypeptide and above the background level of noise are also present in the spectrum of the candidate polypeptide.

In another aspect, a polypeptide is considered to be a polypeptide of the present invention if it has a molecular weight of a reference polypeptide described in Table 2, 3, 4, 5, 6, 7, 8, or 9 and has a mass fingerprint that includes the population of polypeptide fragments of the reference polypeptide as listed in Table 2, 3, 4, 5, 6, 7, 8, or 9. For instance, a polypeptide of the present invention includes a polypeptide of 82 kDa and a mass fingerprint that includes polypeptide fragments having masses of 629.39, 644.37, 772.42, 831.45, 873.46, 991.55, 1083.61, 1208.58, 1325.75, 1378.66, 1500.71, 1619.77, 1634.84, 1619.77, 1728.83, 1872.88, 1981.96, 1998.06, 2193.94, and 2332.05. The mass fingerprint of a candidate polypeptide can be determined by a mass spectrometric method as described herein, preferably, by MALDI-TOF MS. The mass fingerprint of a candidate polypeptide will generally have additional polypeptide fragments and therefore additional m/z values other than those listed for a polypeptide in Table 2, 3, 4, 5, 6, 7, 8, or 9. Preferably, when the candidate polypeptide is being compared to a polypeptide in Table 2, 3, 4, or 5, the candidate polypeptide is obtained from an *S. enterica* serovar Newport, an *S. enterica* serovar Enteritidis, an *S. enterica* serovar Typhimurium, or an *S. enterica* serovar Dublin, respectively. Preferably, when the candidate polypeptide is being compared to a polypeptide in Table 6, 7, 8, or 9, the candidate polypeptide is obtained from an *E. coli*. A candidate polypeptide can be obtained by growth of a microbe under low metal conditions and the subsequent isolation of a polypeptide by the processes described herein.

It is well known in the art that modifications of amino acids can be accidentally introduced during sample handling, such as oxidation, and formation of carbamidomethyl derivatives. Further, these types of modifications alter the m/z value of a polypeptide fragment. For instance, if a polypeptide fragment contains a methoinine that is oxidized the m/z value will be increased by 16 relative to the same fragment that does not contain the oxidized methionine. It is understood that the polypeptide fragments of Tables 2, 3, 4, 5, 6, 7, 8, and 9 can be modified during sample handling.

TABLE 2

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| Lw221 | 82 | 628.39 | IEVLR | (SEQ ID NO: 1) |
| | | 643.37 | QIDIR | (SEQ ID NO: 2) |
| | | 771.42 | DINGVVR | (SEQ ID NO: 3) |
| | | 830.45 | DVSEIIR | (SEQ ID NO: 4) |
| | | 872.46 | LGWRGER | (SEQ ID NO: 5) |
| | | 990.55 | EIGLEFKR | (SEQ ID NO: 6) |
| | | 1082.61 | IEAGTVPLQR | (SEQ ID NO: 7) |
| | | 1207.58 | TGSYADTLPAGR | (SEQ ID NO: 8) |
| | | 1324.75 | NKIEAGTVPLQR | (SEQ ID NO: 9) |
| | | 1377.66 | TDVYQWENVPK | (SEQ ID NO: 10) |
| | | 1463.74 | LYGNLDKTQADAR | (SEQ ID NO: 15) |
| | | 1499.71 | GDTAWVPPEMIER | (SEQ ID NO: 11) |
| | | 1618.77 | TMPGVNLTGNSTSGQR | (SEQ ID NO: 13) |
| | | 1633.84 | NVSLTGGVDNLFDKR | (SEQ ID NO: 14) |
| | | 1727.83 | TNFSLNGPLGGDFSFR | (SEQ ID NO: 16) |
| | | 1871.88 | DTRGDTAWVPPEMIER | (SEQ ID NO: 17) |
| | | 1980.96 | WDFAPLQSLELEAGYSR | (SEQ ID NO: 18) |
| | | 1997.06 | GMGPENTLILIDGKPVTSR | (SEQ ID NO: 19) |
| | | 2192.94 | DTQTGAYMAGAGAYTYNEPGR | (SEQ ID NO: 21) |
| | | 2331.05 | KGGSEWHGSWNTYFNAPEHK | (SEQ ID NO: 22) |

TABLE 2-continued

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| Lw223A | 80 | 848.45 | LYGNLNR | (SEQ ID NO: 23) |
|  |  | 918.45 | LGFYYEK | (SEQ ID NO: 24) |
|  |  | 1040.60 | IVAGDQIIGR | (SEQ ID NO: 25) |
|  |  | 1097.62 | QQPGVSIITR | (SEQ ID NO: 26) |
|  |  | 1309.63 | ITNDQTFTTNR | (SEQ ID NO: 27) |
|  |  | 1335.71 | NPPVNDLADIIR | (SEQ ID NO: 28) |
|  |  | 1341.66 | DSNIAGIPGSAANR | (SEQ ID NO: 29) |
|  |  | 1364.60 | SAEGANTYNEPGR | (SEQ ID NO: 30) |
|  |  | 1528.70 | GDTNWVPPEMVER | (SEQ ID NO: 31) |
|  |  | 1564.76 | SASGAYVLQWQNGGK | (SEQ ID NO: 32) |
|  |  | 1735.86 | GNFSLSGPLAGDTLTMR | (SEQ ID NO: 33) |
|  |  | 1750.86 | EGVTNKDINSVFSWR | (SEQ ID NO: 34) |
|  |  | 1754.83 | MTPQQILDFEAGYSR | (SEQ ID NO: 35) |
|  |  | 1845.91 | APNLYQTSEGYLLYSK | (SEQ ID NO: 36) |
|  |  | 1911.98 | ALIEGIEASMAVPLMPDR | (SEQ ID NO: 37) |
|  |  | 1929.04 | GPAAARYGSGAAGGVVNIITK | (SEQ ID NO: 38) |
|  |  | 1935.01 | DDIQKNPPVNDLADIIR | (SEQ ID NO: 39) |
|  |  | 2030.93 | QNYGLTHNGIWDWGQSR | (SEQ ID NO: 40) |
|  |  | 2416.14 | RPTNDWHGSLSLYTNQPESSK | (SEQ ID NO: 41) |
|  |  | 2587.35 | IVAGDQIIGRSASGAYVLQWQNGGK | (SEQ ID NO: 42) |
|  |  | 2701.36 | SEISALYVEDNIEPMAGTNIIPGLR | (SEQ ID NO: 43) |
|  |  | 2909.36 | FDYLSESGSNFSPSLNLSQELGEYVK | (SEQ ID NO: 44) |
|  |  | 2943.50 | NKSEISALYVEDNIEPMAGTNIIPGLR | (SEQ ID NO: 45) |
| Lw223B | 74 | 605.33 | NAVFR | (SEQ ID NO: 46) |
|  |  | 616.37 | VPVFR | (SEQ ID NO: 47) |
|  |  | 808.41 | IEGFTSR | (SEQ ID NO: 48) |
|  |  | 1063.48 | YFMAVDYR | (SEQ ID NO: 49) |
|  |  | 1158.55 | QNYALSHNGR | (SEQ ID NO: 50) |
|  |  | 1210.55 | YFMAVDYRF | (SEQ ID NO: 51) |
|  |  | 1314.62 | LSLNYTYNDGR | (SEQ ID NO: 52) |
|  |  | 1329.77 | IFEPLALTTGIR | (SEQ ID NO: 53) |
|  |  | 1345.55 | DDYGYTEDGRR | (SEQ ID NO: 54) |

TABLE 2-continued

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1526.73 | EVPGVQLTNEGDNR | (SEQ ID NO: 55) |
| | | 1649.90 | GLDSSYTLILIDGKR | (SEQ ID NO: 56) |
| | | 1677.74 | DEQQSSATTATGETPR | (SEQ ID NO: 57) |
| | | 1740.90 | DAPASISVITQQDLQR | (SEQ ID NO: 58) |
| | | 1744.69 | MDDHETYGDHWSPR | (SEQ ID NO: 59) |
| | | 1750.84 | WHGSVTVDSTIQEHR | (SEQ ID NO: 60) |
| | | 1792.88 | GEEGILEGVEASVTTFR | (SEQ ID NO: 61) |
| | | 1814.85 | TSASQYALFLEDEWR | (SEQ ID NO: 62) |
| | | 1906.92 | TPGGYVVWDTGAAWQATK | (SEQ ID NO: 63) |
| | | 1934.88 | EKDEQQSSATTATGETPR | (SEQ ID NO: 64) |
| | | 1952.94 | HNDFDLNWIPVDAIER | (SEQ ID NO: 65) |
| | | 1987.04 | IQGVETELKVPFNEAWK | (SEQ ID NO: 66) |
| | | 2242.03 | TPDVNAAPGYSNFVGFETNSR | (SEQ ID NO: 67) |
| | | 2538.26 | IVGSPDLKPETSESWELGLYYR | (SEQ ID NO: 68) |
| | | 2587.24 | DRGDTYNGQFFTSGPLIDGVLGMK | (SEQ ID NO: 69) |
| | | 2710.17 | DGNVEFAWTPNENHDVTAGYGFDR | (SEQ ID NO: 70) |
| P4 | 65 | 1303.65 | WQSTSVNDVLR | (SEQ ID NO: 71) |
| | | 1398.57 | YDSDYSAYPYR | (SEQ ID NO: 72) |
| | | 1508.73 | TLYGALEHTFSDR | (SEQ ID NO: 73) |
| | | 1792.85 | QWEGAFEGLTAGVSWR | (SEQ ID NO: 74) |
| | | 1868.85 | QTTTPGTGYVPEGYDQR | (SEQ ID NO: 75) |
| | | 1932.87 | TDYDAYYSPGSPLIDTR | (SEQ ID NO: 76) |
| | | 2023.92 | HGTWQTSAGWEFIEGYR | (SEQ ID NO: 77) |
| | | 2086.08 | LPGVDIAQSGGAGQNSSIFIR | (SEQ ID NO: 78) |
| | | 2257.21 | LNLAGVSGSADLSQFPVSLVQR | (SEQ ID NO: 79) |
| Lw224 | 56 | 1100.52 | DDAAGQAIANR | (SEQ ID NO: 80) |
| | | 1131.59 | SQSALGTAIER | (SEQ ID NO: 81) |
| | | 1254.69 | IDAALAQVDALR | (SEQ ID NO: 82) |
| | | 1715.73 | IEDSDYATEVSNMSR | (SEQ ID NO: 83) |
| | | 1756.93 | QINSQTLGLDSLNVQK | (SEQ ID NO: 84) |
| | | 1958.86 | SRIEDSDYATEVSNMSR | (SEQ ID NO: 85) |
| | | 2034.01 | FNSAITNLGNTVNNLSEAR | (SEQ ID NO: 86) |

TABLE 2-continued

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 2669.30 | NANDGISIAQTTEGALNEI NNNLQR | (SEQ ID NO: 87) |
| | | 2804.34 | ELAVQSANSTNSQSDLDSI QAEITQR | (SEQ ID NO: 88) |
| | | 2859.59 | AQILQQAGTSVLAQANQVP QNVLSLLR | (SEQ ID NO: 89) |
| | | 3059.51 | VRELAVQSANSTNSQSDLD SIQAEITQR | (SEQ ID NO: 90) |
| Lw225 | 55 | 958.48 | SDLGAVQNR | (SEQ ID NO: 91) |
| | | 1100.52 | DDAAGQAIANR | (SEQ ID NO: 92) |
| | | 1131.59 | SQSALGTAIER | (SEQ ID NO: 93) |
| | | 1143.59 | TALNQLGGADGK | (SEQ ID NO: 94) |
| | | 1254.69 | IDAALAQVDALR | (SEQ ID NO: 95) |
| | | 1603.77 | ADVDADGNVSLATGATK | (SEQ ID NO: 96) |
| | | 1613.81 | INSAKDDAAGQAIANR | (SEQ ID NO: 97) |
| | | 1621.82 | AGITGTTTETGSVKDGK | (SEQ ID NO: 98) |
| | | 1639.79 | YDVDSTGVTQSLDLK | (SEQ ID NO: 99) |
| | | 1708.75 | NYYVEVDFTDTTDK | (SEQ ID NO: 100) |
| | | 1715.73 | IEDSDYATEVSNMSR | (SEQ ID NO: 101) |
| | | 1770.95 | QINSQTLGLDTLNVQK | (SEQ ID NO: 102) |
| | | 1903.98 | LNEIDRVSGQTQFNGVK | (SEQ ID NO: 103) |
| | | 1958.86 | SRIEDSDYATEVSNMSR | (SEQ ID NO: 104) |
| | | 2084.12 | AQVINTNSLSLLTQNNLNK | (SEQ ID NO: 105) |
| | | 2195.17 | IDAALAQVDALRSDLGAVQ NR | (SEQ ID NO: 106) |
| | | 2669.30 | NANDGISIAQTTEGALNEI NNNLQR | (SEQ ID NO: 107) |
| | | 2804.34 | ELAVQSANSTNSQSDLDSI QAEITQR | (SEQ ID NO: 108) |
| | | 3059.51 | VRELAVQSANSTNSQSDLD SIQAEITQR | (SEQ ID NO: 109) |
| Lw226 | 52 | 787.46 | SVVQTVR | (SEQ ID NO: 110) |
| | | 799.43 | QQLANAR | (SEQ ID NO: 111) |
| | | 801.43 | LSQDLAR | (SEQ ID NO: 112) |
| | | 827.45 | LSNPELR | (SEQ ID NO: 113) |
| | | 913.53 | NLSLLQAR | (SEQ ID NO: 114) |
| | | 1089.50 | ANSNNGNPFR | (SEQ ID NO: 115) |
| | | 1285.63 | NNLDNAVEELR | (SEQ ID NO: 116) |
| | | 1381.76 | YTYLINQLNIK | (SEQ ID NO: 117) |

TABLE 2-continued

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1549.77 | AQYDTVLANEVTAR | (SEQ ID NO: 118) |
| | | 1615.87 | FNVGLVAITDVQNAR | (SEQ ID NO: 119) |
| | | 1661.90 | VLNAIDVLSYTQAQK | (SEQ ID NO: 120) |
| | | 1737.90 | TIVDVLDATTTLYDAK | (SEQ ID NO: 121) |
| | | 1828.90 | SSFNNINASISSINAYK | (SEQ ID NO: 122) |
| | | 2033.96 | QAQYNFVGASEQLESAHR | (SEQ ID NO: 123) |
| | | 2184.09 | SPLLPQLGLGADYTYSNGYR | (SEQ ID NO: 124) |
| | | 2208.09 | QVTGNYYPELASLNVEHFK | (SEQ ID NO: 125) |
| | | 2226.06 | QAVVSAQSSLDAMEAGYSVGTR | (SEQ ID NO: 126) |
| | | 2684.26 | DANGINSNETSASLQLTQTLFDMSK | (SEQ ID NO: 127) |
| | | 2748.32 | QAQDGHLPTLNLTASTGISDTSYSGSK | (SEQ ID NO: 128) |
| | | 2886.44 | AAGIQDVTYQTDQQTLILNTANAYFK | (SEQ ID NO: 129) |
| Lw227 | 45 | 665.35 | WGYIK | (SEQ ID NO: 130) |
| | | 730.43 | LSLAATR | (SEQ ID NO: 131) |
| | | 812.44 | IFATYAK | (SEQ ID NO: 132) |
| | | 858.46 | LGQEVWK | (SEQ ID NO: 133) |
| | | 963.46 | VDFHGYAR | (SEQ ID NO: 134) |
| | | 1150.53 | DTANDVFDVR | (SEQ ID NO: 135) |
| | | 1223.60 | WDEKWGYIK | (SEQ ID NO: 136) |
| | | 1411.67 | YAAATNSGISTNSR | (SEQ ID NO: 137) |
| | | 1422.69 | WGYIKDGDNISR | (SEQ ID NO: 138) |
| | | 1658.80 | FVVQYATDAMTTQGK | (SEQ ID NO: 139) |
| | | 1683.90 | NLIEWLPGSTIWAGK | (SEQ ID NO: 140) |
| | | 1780.79 | DGWMFTAEHTQSMLK | (SEQ ID NO: 141) |
| | | 1964.99 | WTPIMSTLLEVGYDNVK | (SEQ ID NO: 142) |
| | | 2086.07 | LAGLQTNPDGVLELGVDYGR | (SEQ ID NO: 143) |
| | | 2181.97 | STEAGGSYTFSSQNIYDEVK | (SEQ ID NO: 144) |
| | | 2296.21 | ITLAQQWQAGDSIWSRPAIR | (SEQ ID NO: 145) |
| | | 3100.35 | SFYFDTNVAYSVNQQNDWESTDPAFR | (SEQ ID NO: 146) |
| | | 3314.49 | STEAGGSYTFSSQNIYDEVKDTANDVFDVR | (SEQ ID NO: 147) |

TABLE 2-continued

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| Lw228A | 38 | 718.44 | LAFAGLK | (SEQ ID NO: 148) |
| | | 867.44 | TTGVATYR | (SEQ ID NO: 149) |
| | | 1057.56 | NAEVWAAGLK | (SEQ ID NO: 150) |
| | | 1103.50 | NMSTFVDYK | (SEQ ID NO: 151) |
| | | 1121.57 | DGNKLDLYGK | (SEQ ID NO: 152) |
| | | 1296.54 | FADYGSFDYGR | (SEQ ID NO: 153) |
| | | 1638.83 | VSTDNIVAVGLNYQF | (SEQ ID NO: 154) |
| | | 2218.07 | NTDFFGLVEGLNFAAQYQGK | (SEQ ID NO: 155) |
| | | 2382.03 | VHAQHYFSDDNGSDGDKTYAR | (SEQ ID NO: 156) |
| | | 2389.09 | GETQINDQLTGFGQWEYEFK | (SEQ ID NO: )157 |
| | | 2603.24 | NTDFFGLVEGLNFAAQYQGKNDR | (SEQ ID NO: 158) |
| | | 2716.25 | GETQINDQLTGFGQWEYEFKGNR | (SEQ ID NO: 159) |
| | | 2757.28 | NLGTYGDQDLVEYIDVGATYYFNK | (SEQ ID NO: 160) |
| | | 2805.41 | TQNFEAVAQYQFDFGLRPSIAYLK | (SEQ ID NO: 161) |
| | | 2834.36 | LGFKGETQINDQLTGFGQWEYEFK | (SEQ ID NO: 162) |
| | | 3065.32 | DGAYESNGDGFGLSATYEYEGFGVGAAYAK | (SEQ ID NO: 163) |
| | | 3450.49 | NDRDGAYESNGDGFGLSATYEYEGFGVGAAYAK | (SEQ ID NO: 164) |
| Lw228B | 38 | 704.42 | VAFAGLK | (SEQ ID NO: 165) |
| | | 793.37 | LYGNGDR | (SEQ ID NO: 166) |
| | | 900.41 | GNGYATYR | (SEQ ID NO: 167) |
| | | 908.50 | ATVYTGGLK | (SEQ ID NO: 168) |
| | | 1105.58 | DGNKLDLFGK | (SEQ ID NO: 169) |
| | | 1204.51 | FADAGSFDYGR | (SEQ ID NO: 171) |
| | | 1800.82 | DISNGYGASYGDQDIVK | (SEQ ID NO: 174) |
| | | 1834.81 | FGTSNGSNPSTSYGFANK | (SEQ ID NO: 175) |
| | | 1944.95 | LDLFGKVDGLNYFSDDK | (SEQ ID NO: 170) |
| | | 1985.93 | GKDISNGYGASYGDQDIVK | (SEQ ID NO: 176) |
| | | 2247.08 | NTDFFGLVDGLDFALQYQGK | (SEQ ID NO: 177) |
| | | 2382.01 | VDGLNYFSDDKGSDGDQTYMR | (SEQ ID NO: 178) |

TABLE 2-continued

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 3004.51 | AQNFEVVAQYQFDFGLRPS VAYLQSK | (SEQ ID NO: 180) |
| | | 3133.52 | SLLNQNGDGYGGSLTYAIG EGFSVGGAITTSK | (SEQ ID NO: 181) |
| Lw230A | 36 | 817.43 | LGGMVWR | (SEQ ID NO: 182) |
| | | 871.51 | RVEIEVK | (SEQ ID NO: 183) |
| | | 914.52 | AQGVQLTAK | (SEQ ID NO: 184) |
| | | 1024.46 | DNTWYAGAK | (SEQ ID NO: 185) |
| | | 1082.54 | SDVLFNFNK | (SEQ ID NO: 186) |
| | | 1156.59 | AALIDCLAPDR | (SEQ ID NO: 187) |
| | | 1263.65 | DGSVVVLGFTDR | (SEQ ID NO: 188) |
| | | 1377.76 | RAQSVVDYLISK | (SEQ ID NO: 189) |
| | | 1380.65 | IGSDAYNQGLSEK | (SEQ ID NO: 190) |
| | | 1536.75 | IGSDAYNQGLSEKR | (SEQ ID NO: 191) |
| | | 1639.81 | LGYPITDDLDVYTR | (SEQ ID NO: 192) |
| | | 2302.20 | FGQQEAAPVVAPAPAPAPE VQTK | (SEQ ID NO: 193) |
| | | 2615.29 | DHDTGVSPVFAGGIEYAIT PEIATR | (SEQ ID NO: 194) |
| | | 2672.37 | STLKPEGQQALDQLYSQLS NLDPK | (SEQ ID NO: 195) |
| | | 3422.69 | LEYQWTNNIGDANTIGTRP DNGLLSVGVSYR | (SEQ ID NO: 196) |
| Lw233 | 22 | 1050.53 | VRPYVGVGVNYTTFFDNDF NDNGK | (SEQ ID NO: 202) |
| | | 1221.57 | NAGLSDLSFKDSWGAAGQV GVDYLINR | (SEQ ID NO: 203) |
| | | 1587.75 | VGTGATGDIATVHLLPPTL MAQWYFGDSSSK | (SEQ ID NO: 204) |
| | | 1734.82 | MSGFNLK | (SEQ ID NO: 205) |
| | | 1819.89 | FQTTDYPTYK | (SEQ ID NO: 206) |
| | | 2737.28 | GQYYGITAGPAYR | (SEQ ID NO: 207) |
| | | 2852.41 | SVDVGTWIAGVGYR | (SEQ ID NO: 208) |
| | | 3219.59 | SVDVGTWIAGVGYRF | (SEQ ID NO: 209) |
| Lw234 | 18 | 795.39 | LNDWASIYGVVGVGYGK | (SEQ ID NO: 210) |
| | | 1262.58 | YEQDDNPLGVIGSFTYTEK | (SEQ ID NO: 211) |
| | | 1415.68 | YEQDDNPLGVIGSFTYTEK DR | (SEQ ID NO: 212) |
| | | 1478.75 | YRYEQDDNPLGVIGSFTYT EK | (SEQ ID NO: 213) |
| | | 1625.82 | LDNQATK | (SEQ ID NO: 214) |

TABLE 2-continued

Characteristics of polypeptides obtained from *Salmonella enterica* serovar Newport.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1796.91 | SDVQAAKDDAAR | (SEQ ID NO: 215) |
| | | 2175.00 | ANQRLDNQATK | (SEQ ID NO: 216) |
| | | 2446.13 | VDQLSNDVNAMR | (SEQ ID NO: 217) |
| | | 2494.17 | IDQLSSDVQTLNAK | (SEQ ID NO: 218) |
| Lw235 | 12 | 788.40 | VDQLSNDVNAMRSDVQAAK | (SEQ ID NO: 219) |
| | | 1245.59 | IDQLSSDVQTLNAKVDQLSNDVNAMR | (SEQ ID NO: 220) |

[1]Molecular weight as determined by SDS-PAGE.
[2]The mass of a polypeptide fragment can be converted to m/z value by adding 1 to the mass. Each mass includes a range of plus or minus 300 parts per million (ppm).

TABLE 3

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| Lw98 | 92 | 728.43 | WVVLGR | (SEQ ID NO: 221) |
| | | 815.38 | SYYLDR | (SEQ ID NO: 222) |
| | | 888.41 | YGYAYPR | (SEQ ID NO: 223) |
| | | 957.50 | AGLGYVHNK | (SEQ ID NO: 224) |
| | | 972.50 | QNLEASGVR | (SEQ ID NO: 225) |
| | | 986.54 | LAGDLETLR | (SEQ ID NO: 226) |
| | | 998.45 | GYFPTDGSR | (SEQ ID NO: 227) |
| | | 1008.47 | WGYGDGLGGK | (SEQ ID NO: 228) |
| | | 1047.53 | GFQSNTIGPK | (SEQ ID NO: 229) |
| | | 1076.59 | LVFQEGVSAK | (SEQ ID NO: 230) |
| | | 1113.56 | DIHFEGLQR | (SEQ ID NO: 231) |
| | | 1180.59 | AEQFQFNIGK | (SEQ ID NO: 232) |
| | | 1219.61 | IEPGELYNGTK | (SEQ ID NO: 233) |
| | | 1276.60 | GLEDFYYSVGK | (SEQ ID NO: 234) |
| | | 1282.74 | VAVGAALLSMPVR | (SEQ ID NO: 235) |
| | | 1338.66 | ALFATGNFEDVR | (SEQ ID NO: 236) |
| | | 1384.65 | VTIPGSDNEYYK | (SEQ ID NO: 237) |
| | | 1401.71 | VPGSPDQVDVVYK | (SEQ ID NO: 238) |
| | | 1402.67 | LSNMQPQIAMDR | (SEQ ID NO: 239) |
| | | 1470.69 | DEVPWWNVVGDR | (SEQ ID NO: 240) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1519.80 | ERPTIASITFSGNK | (SEQ ID NO: 241) |
| | | 1527.72 | LGFFETVDTDTQR | (SEQ ID NO: 242) |
| | | 1648.75 | TGDTVNDEDISNTIR | (SEQ ID NO: 243) |
| | | 1691.87 | FNIDSTQVSLTPDKK | (SEQ ID NO: 244) |
| | | 1712.86 | GIYITVNITEGDQYK | (SEQ ID NO: 1352) |
| | | 1732.81 | QMEGAWLGSDLVDQGK | (SEQ ID NO: 1353) |
| | | 1758.82 | YDGDKAEQFQFNIGK | (SEQ ID NO: 1354) |
| | | 1786.87 | VSLDTATYVPIDNDHK | (SEQ ID NO: 1355) |
| | | 1894.97 | LSGVQVSGNLAGHSAEIEK | (SEQ ID NO: 1356) |
| | | 1953.86 | EMPFYENFYAGGSSTVR | (SEQ ID NO: 1357) |
| | | 2159.05 | SYGTDVTLGFPINEYNTLR | (SEQ ID NO: 1358) |
| | | 2254.95 | IFYNDFEADDADLSDYTNK | (SEQ ID NO: 1359) |
| | | 2284.27 | LLIASLLFSSATVYGAEGFVVK | (SEQ ID NO: 1360) |
| | | 2793.46 | IQQINIVGNHAFSTEELISHFQLR | (SEQ ID NO: 1361) |
| | | 2881.34 | NDYQTYSELSVTNPYFTVDGVSLGGR | (SEQ ID NO: 1362) |
| Lw99 | 91 | 904.51 | LVQLNYR | (SEQ ID NO: 1363) |
| | | 924.43 | SGVQYDTR | (SEQ ID NO: 1364) |
| | | 945.53 | SGFLIPNAK | (SEQ ID NO: 1365) |
| | | 1004.49 | WGSLNTEAK | (SEQ ID NO: 1366) |
| | | 1050.50 | IYDDAAVER | (SEQ ID NO: 197) |
| | | 1075.60 | VDGKLIFER | (SEQ ID NO: 198) |
| | | 1109.55 | QAEGQPEPVR | (SEQ ID NO: 199) |
| | | 1199.63 | VQYLYVPYR | (SEQ ID NO: 200) |
| | | 1276.56 | YGSSTDGYATQK | (SEQ ID NO: 201) |
| | | 1294.58 | GNIMWENEFR | (SEQ ID NO: 245) |
| | | 1307.68 | LQADEVQLHQK | (SEQ ID NO: 246) |
| | | 1343.65 | EEQVAEIWNAR | (SEQ ID NO: 247) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1375.72 | IYGQAVHFVNTK | (SEQ ID NO: 248) |
| | | 1417.75 | IASANQVTTGVTTR | (SEQ ID NO: 249) |
| | | 1450.68 | RGNIMWENEFR | (SEQ ID NO: 250) |
| | | 1509.63 | VSDSSYFNDFDSK | (SEQ ID NO: 251) |
| | | 1510.72 | TGSLVWAGDTYWR | (SEQ ID NO: 252) |
| | | 1601.89 | VHLEPTINLPLSNR | (SEQ ID NO: 253) |
| | | 1618.81 | EEQVAEIWNARFK | (SEQ ID NO: 254) |
| | | 1624.79 | GLSSNYGLGTQEMLR | (SEQ ID NO: 255) |
| | | 1668.72 | DTNVWEGDYQMVGR | (SEQ ID NO: 256) |
| | | 1766.91 | NGINQVGAVASWPIADR | (SEQ ID NO: 257) |
| | | 1766.91 | NGINQVGAVASWPIADR | (SEQ ID NO: 258) |
| | | 1792.85 | DMAMLAPGYTQTLEPR | (SEQ ID NO: 259) |
| | | 1808.87 | FNVSVGQIYYFTESR | (SEQ ID NO: 260) |
| | | 1832.89 | FSVGYAVQNFDATVSTK | (SEQ ID NO: 261) |
| | | 2013.02 | TVDALGNVHYDDNQVILK | (SEQ ID NO: 262) |
| | | 2088.13 | VGPVPIFYSPYLQLPVGDK | (SEQ ID NO: 263) |
| | | 2269.01 | GNYPDDAVFTGNVDIMQGNSR | (SEQ ID NO: 264) |
| | | 2298.03 | WENDDKTGSLVWAGDTYWR | (SEQ ID NO: 265) |
| | | 2453.09 | LMATHYQQTNLDSYNSDPNNK | (SEQ ID NO: 266) |
| | | 2554.16 | DQSGIYNYDSSLLQSDYNGLFR | (SEQ ID NO: 267) |
| | | 2572.20 | YASPEYIQATLPSYYSTAEQYK | (SEQ ID NO: 268) |
| Lw101 | 86 | 643.37 | QIDIR | (SEQ ID NO: 269) |
| | | 872.46 | LGWRGER | (SEQ ID NO: 270) |
| | | 950.49 | ETNRLYR | (SEQ ID NO: 271) |
| | | 990.55 | EIGLEFKR | (SEQ ID NO: 272) |
| | | 1082.61 | IEAGTVPLQR | (SEQ ID NO: 273) |
| | | 1084.57 | GNNRQIDIR | (SEQ ID NO: 274) |
| | | 1095.49 | DNYGKETNR | (SEQ ID NO: 275) |
| | | 1151.68 | IEVLRGPAAAR | (SEQ ID NO: 276) |
| | | 1181.55 | NINQGHQSER | (SEQ ID NO: 277) |
| | | 1207.58 | TGSYADTLPAGR | (SEQ ID NO: 278) |
| | | 1324.75 | NKIEAGTVPLQR | (SEQ ID NO: 279) |
| | | 1365.74 | NPPARDVSEIIR | (SEQ ID NO: 280) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1377.66 | TDVYQWENVPK | (SEQ ID NO: 281) |
| | | 1411.78 | EGVINKDINGVVR | (SEQ ID NO: 282) |
| | | 1432.77 | YGNGAAGGVVNIITK | (SEQ ID NO: 283) |
| | | 1463.74 | LYGNLDKTQADAR | (SEQ ID NO: 284) |
| | | 1499.71 | GDTAWVPPEMIER | (SEQ ID NO: 285) |
| | | 1560.86 | YGNGAAGGVVNIITKK | (SEQ ID NO: 286) |
| | | 1560.86 | YGNGAAGGVVNIITKK | (SEQ ID NO: 287) |
| | | 1584.74 | KYDYQGNPVTGTDK | (SEQ ID NO: 288) |
| | | 1618.77 | TMPGVNLTGNSTSGQR | (SEQ ID NO: 289) |
| | | 1633.84 | NVSLTGGVDNLFDKR | (SEQ ID NO: 290) |
| | | 1633.84 | NVSLTGGVDNLFDKR | (SEQ ID NO: 291) |
| | | 1727.83 | TNFSLNGPLGGDFSFR | (SEQ ID NO: 292) |
| | | 1870.95 | APSLYQTNFNYILYSK | (SEQ ID NO: 293) |
| | | 1903.94 | INNGKTDVYQWENVPK | (SEQ ID NO: 294) |
| | | 1974.95 | NSRMPEGLAGGTEGIFDPK | (SEQ ID NO: 295) |
| | | 1980.96 | WDFAPLQSLELEAGYSR | (SEQ ID NO: 296) |
| | | 1997.06 | GMGPENTLILIDGKPVTSR | (SEQ ID NO: 297) |
| | | 2078.00 | QGNLYAGDTQNTNTNQLVK | (SEQ ID NO: 298) |
| | | 2192.94 | DTQTGAYMAGAGAYTYNEPGR | (SEQ ID NO: 299) |
| | | 2233.14 | AYKAPSLYQTNPNYILYSK | (SEQ ID NO: 300) |
| | | 2371.13 | NINQGHQSERTGSYADTLPAGR | (SEQ ID NO: 301) |
| | | 2531.24 | TNFSLNGPLGGDFSFRLYGNLDK | (SEQ ID NO: 302) |
| | | 2622.42 | QIDIRGMGPENTLILIDGKPVTSR | (SEQ ID NO: 303) |
| | | 2632.20 | MKDQLSNSQTFMGGNIPGYSSTNR | (SEQ ID NO: 304) |
| | | 3098.47 | FDHHSIVGDNWSPSLNLSQGLGDDFTLK | (SEQ ID NO: 305) |
| | | 3211.45 | QNYSLTWNGGWNNGVTTSNWVQYEHTR | (SEQ ID NO: 306) |
| | | 3473.51 | DTQTGAYMAGAGAYTYNEPGRTWYMSINTHF | (SEQ ID NO: 307) |
| Lw102 | 83 | 610.29 | YSWR | (SEQ ID NO: 308) |
| | | 628.39 | IEVIR | (SEQ ID NO: 309) |
| | | 848.45 | LYGNLNR | (SEQ ID NO: 310) |
| | | 918.45 | LGFYYEK | (SEQ ID NO: 311) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1040.60 | IVAGDQIIGR | (SEQ ID NO: 312) |
| | | 1097.62 | QQPGVSIITR | (SEQ ID NO: 313) |
| | | 1141.60 | NLDPEISINK | (SEQ ID NO: 314) |
| | | 1153.63 | DTGNPLSIIPK | (SEQ ID NO: 315) |
| | | 1162.50 | MNEGLSGGGEGR | (SEQ ID NO: 316) |
| | | 1218.66 | LNVGISNIFDK | (SEQ ID NO: 317) |
| | | 1309.63 | ITNDQTFTTNR | (SEQ ID NO: 318) |
| | | 1335.71 | NPPVNDLADIIR | (SEQ ID NO: 319) |
| | | 1341.66 | DSNIAGIPGSAANR | (SEQ ID NO: 320) |
| | | 1364.60 | SAEGANTYNEPGR | (SEQ ID NO: 321) |
| | | 1405.76 | YGSGAAGGVVNIITK | (SEQ ID NO: 322) |
| | | 1460.70 | MPGVNLTGNSASGTR | (SEQ ID NO: 323) |
| | | 1528.70 | GDTNWVPPEMVER | (SEQ ID NO: 324) |
| | | 1564.76 | SASGAYVLQWQNGGK | (SEQ ID NO: 325) |
| | | 1564.76 | SASGAYVLQWQNGGK | (SEQ ID NO: 326) |
| | | 1735.86 | GNFSLSGPLAGDTLTMR | (SEQ ID NO: 327) |
| | | 1750.86 | EGVTNKDINSVFSWR | (SEQ ID NO: 328) |
| | | 1754.83 | MTPQQILDFEAGYSR | (SEQ ID NO: 329) |
| | | 1845.91 | APNLYQTSEGYLLYSK | (SEQ ID NO: 330) |
| | | 1880.96 | ALGAYSLVGANVNYDINK | (SEQ ID NO: 331) |
| | | 1911.98 | ALIEGIEASMAVPLMPDR | (SEQ ID NO: 332) |
| | | 1954.02 | GMGPENTLVLIDGVPVTSR | (SEQ ID NO: 333) |
| | | 2030.93 | QNYGLTHNGIWDWGQSR | (SEQ ID NO: 334) |
| | | 2261.06 | EIGLEFTVDDYHASVTYFR | (SEQ ID NO: 335) |
| | | 2397.12 | LYGNLNRTDADSWDINSSAGTK | (SEQ ID NO: 336) |
| | | 2416.14 | RPTNDWHGSLSLYTNQPESSK | (SEQ ID NO: 337) |
| | | 2701.36 | SEISALYVEDNIEPMAGTNIIPGLR | (SEQ ID NO: 338) |
| | | 2909.36 | FDYLSESGSNFSPSLNLSQELGEYVK | (SEQ ID NO: 339) |
| | | 2943.50 | NKSEISALYVEDNIEPMAGTNIIPGLR | (SEQ ID NO: 340) |
| Lw103 | 78 | 605.33 | NAVFR | (SEQ ID NO: 341) |
| | | 614.38 | IEVVR | (SEQ ID NO: 342) |
| | | 616.37 | VPVFR | (SEQ ID NO: 343) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 808.41 | IEGFTSR | (SEQ ID NO: 344) |
| | | 836.42 | GGWATAFK | (SEQ ID NO: 345) |
| | | 989.50 | VPFNEAWK | (SEQ ID NO: 346) |
| | | 1060.52 | WDLGNSELK | (SEQ ID NO: 347) |
| | | 1063.48 | YFMAVDYR | (SEQ ID NO: 348) |
| | | 1140.66 | LRAGVLNVGDK | (SEQ ID NO: 349) |
| | | 1158.55 | QNYALSHNGR | (SEQ ID NO: 350) |
| | | 1177.52 | QDRDSDSLDK | (SEQ ID NO: 351) |
| | | 1177.52 | QDRDSDSLDK | (SEQ ID NO: 352) |
| | | 1210.55 | YFMAVDYRF | (SEQ ID NO: 353) |
| | | 1314.62 | LSLNYTYNDGR | (SEQ ID NO: 354) |
| | | 1329.77 | IFEPLALTTGIR | (SEQ ID NO: 355) |
| | | 1345.55 | DDYGYTEDGRR | (SEQ ID NO: 356) |
| | | 1493.80 | GLDSSYTLILIDGK | (SEQ ID NO: 357) |
| | | 1526.73 | EVPGVQLTNEGDNR | (SEQ ID NO: 358) |
| | | 1570.82 | AYLVYNATDTLTVK | (SEQ ID NO: 359) |
| | | 1649.90 | GLDSSYTLILIDGKR | (SEQ ID NO: 360) |
| | | 1654.83 | EVPGVQLTNEGDNRK | (SEQ ID NO: 361) |
| | | 1740.90 | DAPASISVITQQDLQR | (SEQ ID NO: 362) |
| | | 1744.69 | MDDHETYGDHWSPR | (SEQ ID NO: 363) |
| | | 1750.84 | WHGSVTVDSTIQEHR | (SEQ ID NO: 364) |
| | | 1792.88 | GEEGILEGVEASVTTFR | (SEQ ID NO: 365) |
| | | 1814.85 | TSASQYALFLEDEWR | (SEQ ID NO: 366) |
| | | 1906.92 | TPGGYVVWDTGAAWQATK | (SEQ ID NO: 367) |
| | | 1952.94 | HNDFDLNWIPVDAIER | (SEQ ID NO: 368) |
| | | 2242.03 | TPDVNAAPGYSNFVGFETNSR | (SEQ ID NO: 369) |
| | | 2538.26 | IVGSPDLKPETSESWELGLYYR | (SEQ ID NO: 370) |
| | | 2710.17 | DGNVEFAWTPNENHDVTAGYGF | (SEQ ID NO: 371) |
| Lw104 | 55 | 787.46 | SVVQTVR | (SEQ ID NO: 372) |
| | | 801.43 | LSQDLAR | (SEQ ID NO: 373) |
| | | 913.53 | NLSLLQAR | (SEQ ID NO: 374) |
| | | 1179.55 | SAADRDAAFEK | (SEQ ID NO: 375) |
| | | 1226.55 | ANSNNGNPFRH | (SEQ ID NO: 376) |
| | | 1226.55 | ANSNNGNPFRH | (SEQ ID NO: 377) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| | | 1285.63 | NNLDNAVEELR | (SEQ ID NO: 378) |
| | | 1381.76 | YTYLINQLNIK | (SEQ ID NO: 379) |
| | | 1549.77 | AQYDTVLANEVTAR | (SEQ ID NO: 380) |
| | | 1615.87 | FNVGLVAITDVQNAR | (SEQ ID NO: 381) |
| | | 1661.90 | VLNAIDVLSYTQAQK | (SEQ ID NO: 382) |
| | | 1737.90 | TIVDVLDATTTLYDAK | (SEQ ID NO: 383) |
| | | 1828.90 | SSFNNINASISSINAYK | (SEQ ID NO: 384) |
| | | 2033.96 | QAQYNFVGASEQLESAHR | (SEQ ID NO: 385) |
| | | 2184.09 | SPLLPQLGLGADYTYSNGYR | (SEQ ID NO: 386) |
| | | 2208.09 | QVTGNYYPELASLNVEHFK | (SEQ ID NO: 387) |
| | | 2226.06 | QAVVSAQSSLDAMEAGYSVGTR | (SEQ ID NO: 388) |
| | | 2748.32 | QAQDGHLPTLNLTASTGISDTSYSGSK | (SEQ ID NO: 389) |
| | | 2886.44 | AAGIQDVTYQTDQQTLILNTANAYFK | (SEQ ID NO: 390) |
| Lw106A | 40 | 691.39 | LDLFGK | (SEQ ID NO: 391) |
| | | 704.42 | VAFAGLK | (SEQ ID NO: 392) |
| | | 900.41 | GNGYATYR | (SEQ ID NO: 393) |
| | | 908.50 | ATVYTGGLK | (SEQ ID NO: 394) |
| | | 973.45 | STSYGFANK | (SEQ ID NO: 395) |
| | | 1105.58 | DGNKLDLFGK | (SEQ ID NO: 396) |
| | | 1128.45 | GSDGDQTYMR | (SEQ ID NO: 397) |
| | | 1190.53 | NGSVSGENTNGR | (SEQ ID NO: 398) |
| | | 1204.51 | FADAGSFDYGR | (SEQ ID NO: 399) |
| | | 1438.68 | YVDVGATYYFNK | (SEQ ID NO: 400) |
| | | 1800.82 | DISNGYGASYGDQDIVK | (SEQ ID NO: 401) |
| | | 1890.93 | VAFAGLKFADAGSFDYGR | (SEQ ID NO: 402) |
| | | 1989.84 | TADQNNTADEHLYGNGDR | (SEQ ID NO: 403) |
| | | 2247.08 | NTDFFGLVDGLDFALQYQGK | (SEQ ID NO: 404) |
| | | 2339.08 | YDANNIYLAAQYSQTYNATR | (SEQ ID NO: 405) |
| | | 2405.02 | VDGLHYFSDDKGSDGDQTYMR | (SEQ ID NO: 406) |
| | | 3004.51 | AQNFEVVAQYQFDFGLRPSVAYL | (SEQ ID NO: 407) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment | |
|---|---|---|---|---|
| Lw106B | 39 | 718.44 | LAFAGLK | (SEQ ID NO: 408) |
| | | 867.44 | TTGVATYR | (SEQ ID NO: 409) |
| | | 1057.56 | NAEVWAAGLK | (SEQ ID NO: 410) |
| | | 1103.50 | NMSTFVDYK | (SEQ ID NO: 411) |
| | | 1121.57 | DGNKLDLYGK | (SEQ ID NO: 412) |
| | | 1279.63 | INLLDDSDFTK | (SEQ ID NO: 413) |
| | | 1296.54 | FADYGSFDYGR | (SEQ ID NO: 414) |
| | | 1638.83 | VSTDNIVAVGLNYQF | (SEQ ID NO: 415) |
| | | 1890.78 | VHAQHYFSDDNGSDGDK | (SEQ ID NO: 416) |
| | | 2218.07 | NTDFFGLVEGLNFAAQYQGK | (SEQ ID NO: 417) |
| | | 2218.07 | NTDFFGLVEGLNFAAQYQGK | (SEQ ID NO: 418) |
| | | 2382.03 | VHAQHYFSDDNGSDGDKTYAR | (SEQ ID NO: 419) |
| | | 2389.09 | GETQINDQLTGFGQWEYEFK | (SEQ ID NO: 420) |
| | | 2757.28 | NLGTYGDQDLVEYIDVGATYYFNK | (SEQ ID NO: 421) |
| | | 2805.41 | TQNFEAVAQYQFDFGLRPSIAYLK | (SEQ ID NO: 422) |
| | | 3067.50 | TTGVATYRNTDFFGLVEGLNFAAQYQGK | (SEQ ID NO: 423) |
| Lw108 | 38 | 817.43 | LGGMVWR | (SEQ ID NO: 424) |
| | | 1024.46 | DNTWYAGAK | (SEQ ID NO: 425) |
| | | 1082.54 | SDVLFNFNK | (SEQ ID NO: 426) |
| | | 1156.59 | AALIDCLAPDR | (SEQ ID NO: 427) |
| | | 1221.66 | AQSVVDYLISK | (SEQ ID NO: 428) |
| | | 1232.63 | LGGMVWRADTK | (SEQ ID NO: 429) |
| | | 1263.65 | DGSVVVLGFTDR | (SEQ ID NO: 430) |
| | | 1377.76 | RAQSVVDYLISK | (SEQ ID NO: 431) |
| | | 1380.65 | IGSDAYNQGLSEK | (SEQ ID NO: 432) |
| | | 1469.70 | MPYKGDNINGAYK | (SEQ ID NO: 433) |
| | | 1536.75 | IGSDAYNQGLSEKR | (SEQ ID NO: 434) |
| | | 1639.81 | LGYPITDDLDVYTR | (SEQ ID NO: 435) |
| | | 2302.20 | FGQQEAAPVVAPAPAPAPEVQTK | (SEQ ID NO: 436) |
| | | 2615.29 | DHDTGVSPVFAGGIEYAITPEIATR | (SEQ ID NO: 437) |

TABLE 3-continued

Characteristics of polypeptides obtained from *S. enteritidis* serovar *Enteritidis*.

| polypeptide designation | approximate molecular weight in kilodaltons (kDa)[1] | mass of polypeptide fragments resulting from trypsin digest[2] | predicted amino acid sequence of the polypeptide fragment |
|---|---|---|---|
| | | 2672.37 | STLKPEGQQALDQLYSQLS NLDPK (SEQ ID NO: 438) |
| | | 3422.69 | LEYQWTNNIGDANTIGTRP DNGLLSVGVSYR (SEQ ID NO: 439) |

[1] Molecular weight as determined by SDS-PAGE.
[2] The mass of a polypeptide fragment can be converted to m/z value by adding 1 to the mass. Each mass includes a range of plus or minus 1 Dalton.

TABLE 4

Characteristics of polypeptides obtained from *S. enteritidis* serovar Typhimurium.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| Lw 111 | 86 | 990.55 | EIGLEFKR (SEQ ID NO: 440) |
| | | 1082.61 | IEAGTVPLQR (SEQ ID NO: 441) |
| | | 1181.55 | NINQGHQSER (SEQ ID NO: 442) |
| | | 1207.58 | TGSYADTLPAGR (SEQ ID NO: 443) |
| | | 1306.65 | DGWLAGVTWFR (SEQ ID NO: 444) |
| | | 1324.75 | NKIEAGTVPLQR (SEQ ID NO: 445) |
| | | 1377.66 | TDVYQWENVPK (SEQ ID NO: 446) |
| | | 1432.77 | YGNGAAGGVVNIITK (SEQ ID NO: 447) |
| | | 1477.74 | NVSLTGGVDNLFDK (SEQ ID NO: 448) |
| | | 1499.71 | GDTAWVPPEMIER (SEQ ID NO: 449) |
| | | 1584.74 | KYDYQGNPVTGTDK (SEQ ID NO: 450) |
| | | 1617.77 | MPEGLAGGTEGIFDPK (SEQ ID NO: 451) |
| | | 1618.77 | TMPGVNLTGNSTSGQR (SEQ ID NO: 452) |
| | | 1633.84 | NVSLTGGVDNLFDKR (SEQ ID NO: 453) |
| | | 1658.79 | QDVSLQSTFTWYGK (SEQ ID NO: 454) |
| | | 1727.83 | TNFSLNGPLGGDFSFR (SEQ ID NO: 455) |
| | | 1870.95 | APSLYQTNPNYILYSK (SEQ ID NO: 456) |
| | | 1980.96 | WDFAPLQSLELEAGYSR (SEQ ID NO: 457) |
| | | 1997.06 | GMGPENTLILIDGKPVTSR (SEQ ID NO: 458) |
| | | 2021.05 | QAVSPYSIVGLSATWDVTK (SEQ ID NO: 459) |
| | | 2078.00 | QGNLYAGDTQNTNTNQLVK (SEQ ID NO: 460) |
| | | 2118.15 | LSIIPQYTLNSTLSWQVR (SEQ ID NO: 461) |
| | | 2192.94 | DTQTGAYMAGAGAYTYNEP GR (SEQ ID NO: 462) |
| | | 2202.95 | GGSEWHGSWNTYFNAPEHK (SEQ ID NO: 463) |
| | | 2331.05 | KGGSEWHGSWNTYFNAPEH K (SEQ ID NO: 464) |
| | | 2373.07 | DQLSNSQTFMGGNIPGYSS TNR (SEQ ID NO: 465) |
| | | 2632.20 | MKDQLSNSQTFMGGNIPGY SSTNR (SEQ ID NO: 466) |
| | | 3098.47 | FDHHSIVGDNWSPSLNLSQ GLGDDFTLK (SEQ ID NO: 467) |

TABLE 4-continued

Characteristics of polypeptides obtained from *S. enteritidis* serovar Typhimurium.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| Lw 112 | 82 | 610.29 | YSWR (SEQ ID NO: 468) |
| | | 848.45 | LYGNLNR (SEQ ID NO: 469) |
| | | 918.45 | LGFYYEK (SEQ ID NO: 470) |
| | | 1040.60 | IVAGDQIIGR (SEQ ID NO: 471) |
| | | 1094.54 | DINSVFSWK (SEQ ID NO: 472) |
| | | 1097.62 | QQPGVSIITR (SEQ ID NO: 473) |
| | | 1153.63 | DTGNPLSIIPK (SEQ ID NO: 474) |
| | | 1162.50 | MNEGLSGGGEGR (SEQ ID NO: 475) |
| | | 1208.64 | QKPRTHAESR (SEQ ID NO: 476) |
| | | 1218.66 | LNVGISNIFDK (SEQ ID NO: 477) |
| | | 1309.63 | ITNDQTFTTNR (SEQ ID NO: 478) |
| | | 1335.71 | NPPVNDLADIIR (SEQ ID NO: 479) |
| | | 1341.66 | DSNIAGIPGSAANR (SEQ ID NO: 480) |
| | | 1364.60 | SAEGANTYNEPGR (SEQ ID NO: 481) |
| | | 1405.76 | YGSGAAGGVVNIITK (SEQ ID NO: 482) |
| | | 1528.70 | GDTNWVPPEMVER (SEQ ID NO: 483) |
| | | 1564.76 | SASGAYVLQWQNGGK (SEQ ID NO: 484) |
| | | 1566.68 | TDADSWDINSSAGTK (SEQ ID NO: 485) |
| | | 1735.86 | GNFSLSGPLAGDTLTMR (SEQ ID NO: 486) |
| | | 1754.83 | MTPQQILDFEAGYSR (SEQ ID NO: 487) |
| | | 1845.91 | APNLYQTSEGYLLYSK (SEQ ID NO: 488) |
| | | 1880.96 | ALGAYSLVGANVNYDINK (SEQ ID NO: 489) |
| | | 1882.89 | LNWNTNATYMIASEQK (SEQ ID NO: 490) |
| | | 1911.98 | ALIEGIEASMAVPLMPDR (SEQ ID NO: 491) |
| | | 1929.95 | ITNDQTFTTNRLTSYR (SEQ ID NO: 492) |
| | | 1954.02 | GMGPENTLVLIDGVPVTSR (SEQ ID NO: 493) |
| | | 2030.93 | QNYGLTHNGIWDWGQSR (SEQ ID NO: 494) |
| | | 2192.12 | AFKAPNLYQTSEGYLLYSK (SEQ ID NO: 495) |
| | | 2261.06 | EIGLEFTVDDYHASVTYFR (SEQ ID NO: 496) |
| | | 2416.14 | RPTNDWHGSLSLYTNQPESSK (SEQ ID NO: 497) |
| | | 2449.22 | DITSGGCYLVGNKNLDPEISINK (SEQ ID NO: 498) |
| | | 2701.36 | SEISALYVEDNIEPMAGTNIIPGLR (SEQ ID NO: 499) |
| | | 2909.36 | FDYLSESGSNFSPSLNLSQELGEYVK (SEQ ID NO: 500) |
| | | 2943.50 | NKSEISALYVEDNIEPMAGTNIIPGLR (SEQ ID NO: 501) |
| Lw 113 | 77 | 957.55 | GQRVPVFR (SEQ ID NO: 502) |
| | | 1158.55 | QNYALSHNGR (SEQ ID NO: 503) |
| | | 1177.52 | QDRDSDSLDK (SEQ ID NO: 504) |
| | | 1210.55 | YFMAVDYRF (SEQ ID NO: 505) |
| | | 1308.79 | RPVQNLKDVLK (SEQ ID NO: 506) |
| | | 1314.62 | LSLNYTYNDGR (SEQ ID NO: 507) |
| | | 1329.77 | IFEPLALTTGIR (SEQ ID NO: 508) |
| | | 1345.55 | DDGYTEDGRR (SEQ ID NO: 509) |
| | | 1397.75 | VPVFRYYNVNK (SEQ ID NO: 510) |
| | | 1526.73 | EVPGVQLTNEGDNR (SEQ ID NO: 511) |

TABLE 4-continued

Characteristics of polypeptides obtained from S. enteritidis serovar Typhimurium.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 1649.90 | GLDSSYTLILIDGKR (SEQ ID NO: 512) |
| | | 1654.83 | EVPGVQLTNEGDNRK (SEQ ID NO: 513) |
| | | 1744.69 | MDDHETYGDHWSPR (SEQ ID NO: 514) |
| | | 1750.84 | WHGSVTVDSTIQEHR (SEQ ID NO: 515) |
| | | 1792.88 | GEEGILEGVEASVTTFR (SEQ ID NO: 516) |
| | | 1952.94 | HNDFDLNWIPVDAIER (SEQ ID NO: 517) |
| | | 2021.97 | WHGSVTVDSTIQEHRDR (SEQ ID NO: 518) |
| | | 2201.06 | QNYALSHNGRWDLGNSELK (SEQ ID NO: 519) |
| | | 2242.03 | TPDVNAAPGYSNFVGFETNSR (SEQ ID NO: 520) |
| Lw 115A | 40 | 651.30 | NDFTR (SEQ ID NO: 521) |
| | | 704.42 | VAFAGLK (SEQ ID NO: 522) |
| | | 793.37 | LYGNGDR (SEQ ID NO: 523) |
| | | 900.41 | GNGYATYR (SEQ ID NO: 524) |
| | | 908.50 | ATVYTGGLK (SEQ ID NO: 525) |
| | | 1105.58 | DGNKLDLFGK (SEQ ID NO: 526) |
| | | 1119.49 | NMSTYVDYK (SEQ ID NO: 527) |
| | | 1128.45 | GSDGDQTYMR (SEQ ID NO: 528) |
| | | 1174.53 | TADQNNTANAR (SEQ ID NO: 529) |
| | | 1204.51 | FADAGSFDYGR (SEQ ID NO: 530) |
| | | 1347.71 | INLLDKNDFTR (SEQ ID NO: 531) |
| | | 1438.68 | YVDVGATYYFNK (SEQ ID NO: 532) |
| | | 1800.82 | DISNGYGASYGDQDIVK (SEQ ID NO: 533) |
| | | 1834.81 | FGTSNGSNPSTSYGFANK (SEQ ID NO: 534) |
| | | 1985.93 | GKDISNGYGASYGDQDIVK (SEQ ID NO: 535) |
| | | 2247.08 | NTDFFGLVDGLDFALQYGK (SEQ ID NO: 536) |
| | | 2339.08 | YDANNIYLAAQYSQTYNATR (SEQ ID NO: 537) |
| | | 2405.02 | VDGLHYFSDDKGSDGDQTYMR (SEQ ID NO: 538) |
| | | 3004.51 | AQNFEVVAQYQFDFGLRPSVAYLQSK (SEQ ID NO: 539) |
| | | 3133.52 | SLLNQNGDGYGGSLTYAIGEGFSVGGAITTSK (SEQ ID NO: 540) |
| Lw 115B | 39 | 718.44 | LAFAGLK (SEQ ID NO: 541) |
| | | 867.44 | TTGVATYR (SEQ ID NO: 542) |
| | | 1057.56 | NAEVWAAGLK (SEQ ID NO: 543) |
| | | 1103.50 | NMSTFVDYK (SEQ ID NO: 544) |
| | | 1121.57 | DGNKLDLYGK (SEQ ID NO: 545) |
| | | 1161.54 | GNRTESQGADK (SEQ ID NO: 546) |
| | | 1279.63 | INLLDDSDFTK (SEQ ID NO: 547) |
| | | 1296.54 | FADYGSFDYGR (SEQ ID NO: 548) |
| | | 2218.07 | NTDFFGLVEGLNFAAQYGK (SEQ ID NO: 549) |
| | | 2382.03 | VHAQHYFSDDNGSDGDKTYAR (SEQ ID NO: 550) |
| | | 2389.09 | GETQINDQLTGFGQWEYEFK (SEQ ID NO: 551) |
| | | 2757.28 | NLGTYGDQDLVEYIDVGATYYFNK (SEQ ID NO: 552) |
| | | 2805.41 | TQNFEAVAQYQFDFGLRPSIAYLK (SEQ ID NO: 553) |

TABLE 4-continued

Characteristics of polypeptides obtained from *S. enteritidis* serovar Typhimurium.

| poly-peptide desig-nation | approximate molecular weight in kilodaltons (kDa)[1] | mass value of polypeptide fragments resulting from trypsin digest[2] | predicted amino acid sequence of the polypeptide fragment |
|---|---|---|---|
| | | 3450.49 | NDRDGAYESNGDGFGLSATYEYEGFGVGAAYAK (SEQ ID NO: 554) |
| Lw 117 | 38 | 644.36 | HFTLK (SEQ ID NO: 555) |
| | | 817.43 | LGGMVWR (SEQ ID NO: 556) |
| | | 871.51 | RVEIEVK (SEQ ID NO: 557) |
| | | 914.52 | AQGVQLTAK (SEQ ID NO: 558) |
| | | 942.48 | SNVPGGPSTK (SEQ ID NO: 559) |
| | | 1024.46 | DNTWYAGAK (SEQ ID NO: 560) |
| | | 1042.58 | GIPSDKISAR (SEQ ID NO: 561) |
| | | 1082.54 | SDVLFNFNK (SEQ ID NO: 562) |
| | | 1140.61 | GVKDVVTQPQA (SEQ ID NO: 563) |
| | | 1221.66 | AQSVVDYLISK (SEQ ID NO: 564) |
| | | 1263.65 | DGSVVVLGFTDR (SEQ ID NO: 565) |
| | | 1377.76 | RAQSVVDYLISK (SEQ ID NO: 566) |
| | | 1380.65 | IGSDAYNQGLSEK (SEQ ID NO: 567) |
| | | 1469.70 | MPYKGDNINGAYK (SEQ ID NO: 568) |
| | | 1469.70 | MPYKGDNINGAYK (SEQ ID NO: 569) |
| | | 1536.75 | IGSDAYNQGLSEKR (SEQ ID NO: 570) |
| | | 1639.81 | LGYPITDDLDVYTR (SEQ ID NO: 571) |
| | | 1708.89 | HFTLKSDVLFNFNK (SEQ ID NO: 572) |
| | | 2302.20 | FGQQEAAPVVAPAPAPAPEVQTK (SEQ ID NO: 573) |
| | | 2615.29 | DHDTGVSPVFAGGIEYAITPEIATR (SEQ ID NO: 574) |
| | | 2626.29 | DGSVVVLGFTDRIGSDAYNQGLSEK (SEQ ID NO: 575) |

TABLE 4-continued

Characteristics of polypeptides obtained from *S. enteritidis* serovar Typhimurium.

| poly-peptide desig-nation | approximate molecular weight in kilodaltons (kDa)[1] | mass value of polypeptide fragments resulting from trypsin digest[2] | predicted amino acid sequence of the polypeptide fragment |
|---|---|---|---|
| | | 2672.37 | STLKPEGQQALDQLYSQLSNLDPK (SEQ ID NO: 576) |
| | | 3422.69 | LEYQWTNNIGDANTIGTRPDNGLLSVGVSYR (SEQ ID NO: 577) |
| | | 3539.75 | SNVPGGPSTKDHDTGVSPVFAGGIEYAITPEIATR (SEQ ID NO: 578) |

[1]Molecular weight as determined by SDS-PAGE.
[2]The mass of a polypeptide fragment can be converted to m/z value by adding 1 to the mass. Each mass includes a range of plus or minus 1 Dalton.

TABLE 5

Characteristics of polypeptides obtained from *S. enteritidis* serovar Dublin.

| poly-peptide desig-nation | approximate molecular weight in kilodaltons (kDa)[1] | mass value of polypeptide fragments resulting from trypsin digest[2] | predicted amino acid sequence of the polypeptide fragment |
|---|---|---|---|
| Dublin 1 (SD1) | 96 | 1082.61 | IEAGTVPLQR (SEQ ID NO: 579) |
| | | 1207.58 | TGSYADTLPAGR (SEQ ID NO: 580) |
| | | 1298.57 | TWYMSINTHF (SEQ ID NO: 581) |
| | | 1377.66 | TDVYQWENVPK (SEQ ID NO: 582) |
| | | 1499.71 | GDTAWVPPEMIER (SEQ ID NO: 583) |
| | | 1617.77 | MPEGLAGGTEGIFDPK (SEQ ID NO: 585) |
| | | 1727.83 | TNFSLNGPLGGDFSFR (SEQ ID NO: 586) |
| | | 1870.95 | APSLYQTNPNYILYSK (SEQ ID NO: 587) |
| | | 1956.05 | GPAAARYGNGAAGGVVNIITK (SEQ ID NO: 588) |
| | | 1980.96 | WDFAPLQSLELEAGYSR (SEQ ID NO: 589) |
| | | 1997.06 | GMGPENTLILIDGKPVTSR (SEQ ID NO: 590) |
| | | 2118.15 | LSIIPQYTLNSTLSWQVR (SEQ ID NO: 592) |

TABLE 5-continued

Characteristics of polypeptides obtained from S. enteritidis serovar Dublin.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 2192.94 | DTQTGAYMAGAGAYTYNEPGR (SEQ ID NO: 593) |
| | | 2202.95 | GGSEWHGSWNTYFNAPEHK (SEQ ID NO: 594) |
| | | 2331.05 | KGGSEWHGSWNTYFNAPEHK (SEQ ID NO: 596) |
| Dublin-2 (SD2) | 89 | 610.29 | YSWR (SEQ ID NO: 597) |
| | | 628.39 | IEVIR (SEQ ID NO: 598) |
| | | 848.45 | LYGNLNR (SEQ ID NO: 599) |
| | | 918.45 | LGFYYEK (SEQ ID NO: 600) |
| | | 1040.60 | IVAGDQIIGR (SEQ ID NO: 601) |
| | | 1097.62 | QQPGVSIITR (SEQ ID NO: 602) |
| | | 1218.66 | LNVGISNIFDK (SEQ ID NO: 603) |
| | | 1309.63 | ITNDQTFTTNR (SEQ ID NO: 604) |
| | | 1335.71 | NPPVNDLADIIR (SEQ ID NO: 605) |
| | | 1341.66 | DSNIAGIPGSAANR (SEQ ID NO: 606) |
| | | 1364.60 | SAEGANTYNEPGR (SEQ ID NO: 607) |
| | | 1528.70 | GDTNWVPPEMVER (SEQ ID NO: 608) |
| | | 1564.76 | SASGAYVLQWQNGGK (SEQ ID NO: 609) |
| | | 1735.86 | GNFSLSGPLAGDTLTMR (SEQ ID NO: 610) |
| | | 1750.86 | EGVTNKDINSVFSWR (SEQ ID NO: 611) |
| | | 1845.91 | APNLYQTSEGYLLYSK (SEQ ID NO: 612) |
| | | 1880.96 | ALGAYSLVGANVNYDINK (SEQ ID NO: 613) |
| | | 1911.98 | ALIEGIEASMAVPLMPDR (SEQ ID NO: 614) |
| | | 2261.06 | EIGLEFTVDDYHASVTYFR (SEQ ID NO: 615) |
| | | 2416.14 | RPTNDWHGSLSLYTNQPESSK (SEQ ID NO: 616) |
| | | 2701.36 | SEISALYVEDNIEPMAGTNIIPGLR (SEQ ID NO: 617) |
| | | 2909.36 | FDYLSESGSNFSPSLNLSQELGEYVK (SEQ ID NO: 618) |
| Dublin-3 (SD3) | 81 | 605.33 | NAVFR (SEQ ID NO: 619) |
| | | 616.37 | VPVFR (SEQ ID NO: 620) |
| | | 989.50 | VPFNEAWK (SEQ ID NO: 621) |
| | | 1063.48 | YFMAVDYR (SEQ ID NO: 622) |
| | | 1177.52 | QDRDSDSLDK (SEQ ID NO: 623) |
| | | 1314.62 | LSLNYTYNDGR (SEQ ID NO: 624) |
| | | 1329.77 | IFEPLALTTGIR (SEQ ID NO: 625) |
| | | 1526.73 | EVPGVQLTNEGDNR (SEQ ID NO: 626) |
| | | 1649.90 | GLDSSYTLILIDGKR (SEQ ID NO: 627) |
| | | 1740.90 | DAPASISVITQQDLQR (SEQ ID NO: 628) |
| | | 1744.69 | MDDHETYGDHWSPR (SEQ ID NO: 629) |
| | | 1750.84 | WHGSVTVDSTIQEHR (SEQ ID NO: 630) |
| | | 1792.88 | GEEGILEGVEASVTTFR (SEQ ID NO: 631) |
| | | 1814.85 | TSASQYALFLEDEWR (SEQ ID NO: 632) |
| | | 1906.92 | TPGGYVVWDTGAAWQATK (SEQ ID NO: 633) |
| | | 1934.88 | EKDEQQSSATTATGETPR (SEQ ID NO: 634) |
| | | 1952.94 | HNDFDLNWIPVDAIER (SEQ ID NO: 635) |
| | | 2196.14 | YVLPLASVNQFLTFGGEWR (SEQ ID NO: 636) |
| | | 2242.03 | TPDVNAAPGYSNFVGFETNSR (SEQ ID NO: 637) |

TABLE 5-continued

Characteristics of polypeptides obtained from *S. enteritidis* serovar Dublin.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 2551.23 | ADSATAKTPGGYVVWDTGAAWQATK (SEQ ID NO: 638) |
| | | 2587.24 | DRGDTYNGQFFTSGPLIDGVLGMK (SEQ ID NO: 639) |
| | | 2710.17 | DGNVEFAWTPNENHDVTAGYGFDR (SEQ ID NO: 640) |
| Dublin-4 (SD4) | 61 | 631.37 | LSSGLR (SEQ ID NO: 641) |
| | | 944.50 | SSLGAIQNR (SEQ ID NO: 642) |
| | | 1100.52 | DDAAGQAIANR (SEQ ID NO: 643) |
| | | 1115.56 | SIQDEIQQR (SEQ ID NO: 644) |
| | | 1163.58 | SQSSLSSAIER (SEQ ID NO: 645) |
| | | 1316.67 | SLGLDGFNVNGPK (SEQ ID NO: 646) |
| | | 1473.77 | STANPLASIDSALSK (SEQ ID NO: 647) |
| | | 1763.81 | NVTGYDTYAAGADKYR (SEQ ID NO: 648) |
| | | 1832.86 | NVYTSVVNGQFTFDDK (SEQ ID NO: 649) |
| | | 2007.00 | FDSAITNLGNTVTNLNSAR (SEQ ID NO: 650) |
| | | 2084.12 | AQVINTNSLSLLTQNNLNK (SEQ ID NO: 651) |
| | | 2669.30 | NANDGISIAQTTEGALNEINNNLQR (SEQ ID NO: 652) |
| | | 2682.28 | VYVNAANGQLTTDDAENNTAVDLFK (SEQ ID NO: 653) |
| | | 2859.59 | AQILQQAGTSVLAQANQVPQNVLSLLR (SEQ ID NO: 654) |
| Dublin-5 (SD5) | 56 | 913.53 | NLSLLQAR (SEQ ID NO: 655) |
| | | 988.49 | QLDQTTQR (SEQ ID NO: 656) |
| | | 1285.63 | NNLDNAVEELR (SEQ ID NO: 657) |
| | | 1381.76 | YTYLINQLNIK (SEQ ID NO: 658) |
| | | 1549.77 | AQYDTVLANEVTAR (SEQ ID NO: 659) |
| | | 1615.87 | FNVGLVAITDVQNAR (SEQ ID NO: 670) |
| | | 1661.90 | VLNAIDVLSYTQAQK (SEQ ID NO: 671) |
| | | 1737.90 | TIVDVLDATTTLYDAK (SEQ ID NO: 672) |
| | | 1828.90 | SSFNNINASISSINAYK (SEQ ID NO: 673) |
| | | 2033.96 | QAQYNFVGASEQLESAHR (SEQ ID NO: 674) |
| | | 2184.09 | SPLLPQLGLGADYTYSNGYR (SEQ ID NO: 675) |
| | | 2208.09 | QVTGNYYPELASLNVEHFK (SEQ ID NO: 676) |
| Dublin-6 (SD6) | 51 | 944.50 | SSLGAIQNR (SEQ ID NO: 677) |
| | | 1115.56 | SIQDEIQQR (SEQ ID NO: 678) |
| | | 1220.61 | VSNQTQFNGVK (SEQ ID NO: 679) |
| | | 1316.67 | SLGLDGFNVNGPK (SEQ ID NO: 680) |
| | | 1444.65 | NVTGYDTYAAGADK (SEQ ID NO: 681) |
| | | 1473.77 | STANPLASIDSALSK (SEQ ID NO: 682) |
| | | 1813.94 | IQVGANDGETITIDLQK (SEQ ID NO: 683) |
| | | 1832.86 | NVYTSVVNGQFTFDDK (SEQ ID NO: 684) |
| | | 2007.00 | FDSAITNLGNTVTNLNSAR (SEQ ID NO: 685) |
| | | 2669.30 | NANDGISIAQTTEGALNEINNNLQR (SEQ ID NO: 686) |
| | | 2682.28 | VYVNAANGQLTTDDAENNTAVDLFK (SEQ ID NO: 687) |
| | | 2859.59 | AQILQQAGTSVLAQANQVPQNVLSLL (SEQ ID NO: 688) |
| Dublin-7 (SD7) | 43 | 1171.64 | ELVNMIVAQR (SEQ ID NO: 689) |

TABLE 5-continued

Characteristics of polypeptides obtained from S. enteritidis serovar Dublin.

| poly-peptide desig-nation | approximate molecular weight in kilodal-tons (kDa)[1] | mass value of polypeptide fragments resulting from trypsin digest[2] | predicted amino acid sequence of the polypeptide fragment |
|---|---|---|---|
| | | 1342.65 | LVDSNGSVFYSR (SEQ ID NO: 691) |
| | | 1375.61 | SGTASFADMFAGSK (SEQ ID NO: 692) |
| | | 1422.73 | GLDVAISQNGFFR (SEQ ID NO: 694) |
| | | 1526.84 | TQDQILNTLVNLR (SEQ ID NO: 695) |
| | | 1853.88 | VAGITQDFTDGTTTNTGR (SEQ ID NO: 696) |
| | | 2344.08 | GTVTVYDSQGNAHDMNVYFVK (SEQ ID NO: 697) |
| | | 3078.44 | TKDNEWAVYTHDSSDPAATAPTTASTTLK (SEQ ID NO: 699) |
| Dublin-8 (SD8) | 40 | 1204.51 | FADAGSFDYGR (SEQ ID NO: 700) |
| | | 1347.71 | INLLDKNDFTR (SEQ ID NO: 701) |
| | | 1438.68 | YVDVGATYYFNK (SEQ ID NO: 702) |
| | | 1800.82 | DISNGYGASYGDQDIVK (SEQ ID NO: 703) |
| | | 1834.81 | FGTSNGSNPSTSYGFANK (SEQ ID NO: 704) |
| | | 2247.08 | NTDFFGLVDGLDFALQYQGK (SEQ ID NO: 705) |
| | | 2339.08 | YDANNIYLAAQYSQTYNATR (SEQ ID NO: 706) |
| | | 2405.02 | VDGLHYFSDDKGSDGDQTYMR (SEQ ID NO: 707) |
| | | 3004.51 | AQNFEVVAQYQFDFGLRPSVAYLQSK (SEQ ID NO: 708) |
| Dublin-10 (SD9) | 38 | 817.43 | LGGMVWR (SEQ ID NO: 709) |
| | | 1263.65 | DGSVVVLGFTDR (SEQ ID NO: 710) |
| | | 1639.81 | LGYPITDDLDVYTR (SEQ ID NO: 711) |
| | | 2302.20 | FGQQEAAPVVAPAPAPAPEVQTK (SEQ ID NO: 712) |
| | | 2615.29 | DHDTGVSPVFAGGIEYAITPEIATR (SEQ ID NO: 713) |
| | | 2672.37 | STLKPEGQQALDQLYSQLSNLDPK (SEQ ID NO: 714) |
| | | 3422.69 | LEYQWTNNIGDANTIGTRPDNGLLSVGVSYR (SEQ ID NO: 715) |

[1]Molecular weight as determined by SDS-PAGE.
[2]The mass of a polypeptide fragment can be converted to m/z value by adding 1 to the mass. Each mass includes a range of plus or minus 300 ppm for the polypeptide fragments from the 96 kDa reference polypeptide; plus or minus 1 Dalton for the polypeptide fragments from the 89 kDa, 81 kDa, 61 kDa, 56 kDa, 51 kDa, 40 kDa, and 38 kDa reference polypeptides; and plus or minus 450 ppm for the polypeptide fragments from the 43 kDa polypeptide.

TABLE 6

Characteristics of polypeptides obtained from an E. coli.

| poly-peptide desig-nation | approximate molecular weight in kilodal-tons (kDa)[1] | mass value of polypeptide fragments resulting from trypsin digest[2] | predicted amino acid sequence of the polypeptide fragment |
|---|---|---|---|
| Lw118 | 90 | 628.39 | IEVLR (SEQ ID NO: 716) |
| | | 771.42 | DINGVVR (SEQ ID NO: 717) |
| | | 830.45 | DVSEIIR (SEQ ID NO: 718) |
| | | 990.55 | EIGLEFKR (SEQ ID NO: 719) |
| | | 1177.61 | AGTYATTLPAGR (SEQ ID NO: 720) |
| | | 1284.56 | TWYMSVNTHF (SEQ ID NO: 721) |
| | | 1320.66 | DGWLAGITWFR (SEQ ID NO: 722) |
| | | 1367.75 | NPVARDVSEIIR (SEQ ID NO: 723) |
| | | 1432.77 | YGNGAAGGVVNIITK (SEQ ID NO: 724) |
| | | 1515.70 | GDTSWVPPEMIER (SEQ ID NO: 725) |
| | | 1618.77 | TMPGVNLTGNSTSGQR (SEQ ID NO: 726) |

TABLE 6-continued

Characteristics of polypeptides obtained from an E. coli.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 1633.84 | NVSLTGGVDNLFDKR (SEQ ID NO: 727) |
| | | 1705.77 | EDLSMQTTFTWYGK (SEQ ID NO: 728) |
| | | 1786.85 | TNFSLTGPLGDEFSFR (SEQ ID NO: 729) |
| | | 1796.82 | TQADAWDINQGHQSAR (SEQ ID NO: 730) |
| | | 1870.95 | APSLYQTNPNYILYSK (SEQ ID NO: 731) |
| | | 1965.01 | EISPYSIVGLSATWDVTK (SEQ ID NO: 732) |
| | | 1980.96 | WDFAPLQSLELEAGYSR (SEQ ID NO: 733) |
| | | 2087.91 | QGNLYAGDTQNTNSDAYTR (SEQ ID NO: 734) |
| | | 2173.92 | GSGEWHGSWDAYFNAPEHK (SEQ ID NO: 735) |
| | | 2302.02 | KGSGEWHGSWDAYFNAPEHK (SEQ ID NO: 736) |
| | | 2600.24 | LYGNLDKTQADAWDINQGHQSAR (SEQ ID NO: 737) |
| | | 2706.33 | IEAGYVAVGQNAVGTDLYQWDNVPK (SEQ ID NO: 738) |
| | | 2843.31 | AGNAQTTGDLAGANYIAGAGAYTYNEPGR (SEQ ID NO: 739) |
| | | 3081.49 | FDHHSIVGNNWSPALNISQGLGDDFTLK (SEQ ID NO: 740) |
| | | 3212.43 | QNYSLTWNGGWDNGVTTSNWVQYEHTR (SEQ ID NO: 741) |
| Lw119 | 86 | 975.44 | DPANSGPYR (SEQ ID NO: 742) |
| | | 991.55 | QVVATATFR (SEQ ID NO: 743) |
| | | 1094.51 | DDKQFTWR (SEQ ID NO: 744) |
| | | 1246.63 | RLPTDFNEGAK (SEQ ID NO: 745) |
| | | 1277.70 | VGSYTVVDALVR (SEQ ID NO: 746) |
| | | 1358.69 | GASNTYDHLIIR (SEQ ID NO: 747) |
| | | 1395.61 | YDWADQESLNR (SEQ ID NO: 748) |
| | | 1435.73 | EALSYTPGVSVGTR (SEQ ID NO: 749) |
| | | 1492.65 | YTGSSYGDPANSFK (SEQ ID NO: 750) |
| | | 1571.87 | RPTTEPLKEVQFK (SEQ ID NO: 751) |
| | | 1649.82 | YAIAPAFTWRPDDK (SEQ ID NO: 752) |
| | | 1664.78 | QTGVYVQDQAQWDK (SEQ ID NO: 753) |
| | | 1809.86 | GFAAEGQSQNNYLNGLK (SEQ ID NO: 754) |
| | | 1912.96 | VGMAGSNVALHVNNLFDR (SEQ ID NO: 755) |
| | | 2133.15 | YVPEDRPIVVTGAVYNLTK (SEQ ID NO: 756) |
| | | 2209.96 | TSQNSVYGYGVCSDPANAYSK (SEQ ID NO: 757) |
| | | 2269.03 | TNNLMADPEGSFFSVEGGEIR (SEQ ID NO: 758) |
| LW-1A-3 | 83 | 836.45 | TLRYER (SEQ ID NO: 759) |
| | | 883.47 | WGLAGQPR (SEQ ID NO: 760) |
| | | 1047.46 | SEQRDGDNK (SEQ ID NO: 761) |
| | | 1126.59 | DKWGLAGQPR (SEQ ID NO: 762) |
| | | 1337.62 | DGQLGSLTGGYDR (SEQ ID NO: 763) |
| | | 1350.68 | DGVVLASTGETFR (SEQ ID NO: 764) |
| | | 1396.63 | SYLNWNETENK (SEQ ID NO: 765) |
| | | 1471.73 | FTQNYSSLSAVQK (SEQ ID NO: 766) |
| | | 1604.85 | GMPASYTLILIDGVR (SEQ ID NO: 767) |
| | | 1649.85 | AYLVWDVADAWTLK (SEQ ID NO: 768) |
| | | 1721.84 | IPYPTESQNYNLGAR (SEQ ID NO: 769) |

TABLE 6-continued

Characteristics of polypeptides obtained from an *E. coli.*

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 1726.76 | YEHHEQFGGHFSPR (SEQ ID NO: 770) |
| | | 1758.89 | WLSSVNAGLNLQESNK (SEQ ID NO: 771) |
| | | 1812.80 | ASEQDVLWFDMDTTR (SEQ ID NO: 772) |
| | | 2266.14 | GPMSTLYGSDAMGGVVNIITRK (SEQ ID NO: 774) |
| | | 2512.18 | STLYAGDYFQTGSSTTGYVIPER (SEQ ID NO: 775) |
| Lw121 | 79 | 715.38 | HFSIGR (SEQ ID NO: 776) |
| | | 951.48 | IYWSEVR (SEQ ID NO: 777) |
| | | 1134.55 | IWGWDVMTK (SEQ ID NO: 778) |
| | | 1154.67 | DLPITLLGGTR (SEQ ID NO: 779) |
| | | 1221.63 | MSRPQFTSLR (SEQ ID NO: 780) |
| | | 1335.64 | DLLQEGQSSGFR (SEQ ID NO: 781) |
| | | 1395.64 | INAQNTGSSGEYR (SEQ ID NO: 782) |
| | | 1446.71 | TENLDGIVAWSSR (SEQ ID NO: 783) |
| | | 1511.74 | LAPQGNDWLNADAK (SEQ ID NO: 784) |
| | | 1531.71 | EYWSPQGIPQDGR (SEQ ID NO: 785) |
| | | 1652.79 | QEQHPGGATTGFPQAK (SEQ ID NO: 786) |
| | | 1656.77 | FDDLMLSNDALEFK (SEQ ID NO: 787) |
| | | 1676.80 | YTTDLFSLDVAYNR (SEQ ID NO: 788) |
| | | 1716.88 | GTWQIDSAQSLSGLVR (SEQ ID NO: 789) |
| | | 1778.88 | IDFSSGWLQDEITLR (SEQ ID NO: 790) |
| | | 1859.83 | NPQTVEASESSNPMVDR (SEQ ID NO: 791) |
| | | 1962.95 | VFGTGGTGDHSLGLGASAFGR (SEQ ID NO: 792) |
| | | 2261.08 | QPGYGVNDFYVSYQGQQALK (SEQ ID NO: 793) |
| | | 2397.13 | STLFADSFASHLLTYGGEYYR (SEQ ID NO: 794) |
| LW-1A-5A | 66 | 631.37 | LSSGLR (SEQ ID NO: 795) |
| | | 944.50 | SSLGAIQNR (SEQ ID NO: 796) |
| | | 1190.59 | NQSALSSSIER (SEQ ID NO: 797) |
| | | 1237.66 | LNTTTGLYDLK (SEQ ID NO: 798) |
| | | 1439.81 | AQIIQQAGNSVLAK (SEQ ID NO: 799) |
| | | 1560.83 | VSGQTQFNGVNVLAK (SEQ ID NO: 800) |
| | | 1646.83 | DYAPAIGTAVNVNSAGK (SEQ ID NO: 801) |
| | | 1790.92 | KIDSDTLGLNGFNVNGK (SEQ ID NO: 802) |
| | | 2060.95 | TIGFTAGESSDAAKSYVDDK (SEQ ID NO: 803) |
| | | 2084.12 | AQVINTNSLSLITQNNINK (SEQ ID NO: 804) |
| | | 2189.01 | AASEGSDGASLTFNGTEYTIAK (SEQ ID NO: 805) |
| | | 2248.09 | LDSAVTNLNNTTTNLSEAQSR (SEQ ID NO: 806) |
| | | 2454.34 | ATPATTTPVAPLIPGGITYQATVSK (SEQ ID NO: 807) |
| | | 2628.27 | NANDGISVAQTTEGALSEINNNLQR (SEQ ID NO: 808) |
| LW-1A-5B | 66 | 678.37 | VEYIR (SEQ ID NO: 809) |
| | | 1294.63 | LYSQSWDAGLR (SEQ ID NO: 810) |
| | | 1298.53 | DYNYDPHYGR (SEQ ID NO: 811) |
| | | 1303.65 | WQSTSVNDVLR (SEQ ID NO: 812) |
| | | 1422.73 | KLYSQSWDAGLR (SEQ ID NO: 813) |

TABLE 6-continued

Characteristics of polypeptides obtained from an *E. coli*.

| poly-peptide desig-nation | approximate molecular weight in kilodal-tons (kDa)[1] | mass value of polypeptide fragments resulting from trypsin digest[2] | predicted amino acid sequence of the polypeptide fragment |
|---|---|---|---|
| | | 1549.86 | GTNASHVLVLIDGVR (SEQ ID NO: 814) |
| | | 1819.86 | QWEGAFEGLTAGVNWR (SEQ ID NO: 815) |
| | | 1892.00 | SAVYGSDAIGGVVNIITTR (SEQ ID NO: 816) |
| | | 1917.87 | TNYDAYYSPGSPLVDTR (SEQ ID NO: 817) |
| | | 2158.14 | LPGVDITQNGGSGQLSSIFIR (SEQ ID NO: 818) |
| | | 2323.11 | IANLFDKDYETVYGYQTAGR (SEQ ID NO: 819) |
| | | 2357.17 | NTGIYLTGLQQVGDFTFEGAAR (SEQ ID NO: 820) |
| | | 2698.25 | GVEATANFDTGPLTHTVSYDYVDAR (SEQ ID NO: 821) |
| LW-1A-6 | 56 | 1284.64 | NNLDNAVEQLR (SEQ ID NO: 822) |
| | | 1394.76 | YNYLINQLNIK (SEQ ID NO: 823) |
| | | 1549.77 | AQYDTVLANEVTAR (SEQ ID NO: 824) |
| | | 1615.87 | FNVGLVAITDVQNAR (SEQ ID NO: 825) |
| | | 1828.90 | SSFNNINASISSINAYK (SEQ ID NO: 826) |
| | | 2033.96 | QAQYNFVGASEQLESAHR (SEQ ID NO: 827) |
| | | 2123.10 | VGLSFSLPIYQGGMVNSQVK (SEQ ID NO: 828) |
| | | 2183.09 | QITGNYYPELAALNVENFK (SEQ ID NO: 829) |
| | | 2226.05 | QAVVSAQSSLDAMEAGYSVGTR (SEQ ID NO: 830) |
| Lw123 | 38 | 704.42 | VAFAGLK (SEQ ID NO: 831) |
| | | 884.41 | GNGFATYR (SEQ ID NO: 832) |
| | | 930.49 | VGSLGWANK (SEQ ID NO: 833) |
| | | 938.47 | AETYTGGLK (SEQ ID NO: 834) |
| | | 1119.49 | NMSTYVDYK (SEQ ID NO: 835) |
| | | 1121.57 | DGNKLDLYGK (SEQ ID NO: 836) |
| | | 1123.50 | NYDDEDILK (SEQ ID NO: 837) |
| | | 1170.50 | SVDGDQTYMR (SEQ ID NO: 838) |
| | | 1289.57 | FQDVGSFDYGR (SEQ ID NO: 839) |
| | | 1347.68 | INLLDDNQFTR (SEQ ID NO: 840) |
| | | 1378.59 | NGSVSGEGMTNNGR (SEQ ID NO: 841) |
| | | 1378.59 | NGSVSGEGMTNNGR (SEQ ID NO: 842) |
| | | 1438.68 | YVDVGATYYFNK (SEQ ID NO: 843) |
| | | 1663.74 | TDDQNSPLYIGNGDR (SEQ ID NO: 844) |
| | | 1819.84 | RTDDQNSPLYIGNGDR (SEQ ID NO: 845) |
| | | 1819.84 | RTDDQNSPLYIGNGDR (SEQ ID NO: 846) |
| | | 2232.09 | NTDFFGLVDGLNFAVQYQGK (SEQ ID NO: 847) |
| | | 2353.10 | YDANNIYLAAQYTQTYNATR (SEQ ID NO: 848) |
| | | 2447.07 | VDGLHYFSDDKSVDGDQTYMR (SEQ ID NO: 849) |
| | | 2584.20 | TDDQNSPLYIGNGDRAETYTGGLK (SEQ ID NO: 850) |
| | | 2791.30 | QNGDGVGGSITYDYEGFGIGAAVSSSKR (SEQ ID NO: 851) |
| | | 2990.49 | AQNFEAVAQYQFDFGLRPSLAYLQSK (SEQ ID NO: 852) |
| | | 3104.47 | EALRQNGDGVGGSITYDYEGFGIGAAVSSSK (SEQ ID NO: 853) |
| Lw124 | 37 | 817.43 | LGGMVWR (SEQ ID NO: 854) |

TABLE 6-continued

Characteristics of polypeptides obtained from an *E. coli*.

| poly-peptide desig-nation | approximate molecular weight in kilodaltons (kDa)[1] | mass value of polypeptide fragments resulting from trypsin digest[2] | predicted amino acid sequence of the polypeptide fragment |
|---|---|---|---|
| | | 914.52 | AQGVQLTAK (SEQ ID NO: 855) |
| | | 1026.58 | GIPADKISAR (SEQ ID NO: 856) |
| | | 1054.47 | DNTWYTGAK (SEQ ID NO: 857) |
| | | 1082.54 | SDVLFNFNK (SEQ ID NO: 858) |
| | | 1154.63 | GIKDVVTQPQA (SEQ ID NO: 859) |
| | | 1221.66 | AQSVVDYLISK (SEQ ID NO: 860) |
| | | 1279.64 | DGSVVVLGYTDR (SEQ ID NO: 861) |
| | | 1377.76 | RAQSVVDYLISK (SEQ ID NO: 862) |
| | | 1408.66 | IGSDAYNQGLSER (SEQ ID NO: 863) |
| | | 1442.69 | MPYKGSVENGAYK (SEQ ID NO: 864) |
| | | 1564.76 | IGSDAYNQGLSERR (SEQ ID NO: 865) |
| | | 1653.82 | LGYPITDDLDIYTR (SEQ ID NO: 866) |
| | | 1708.89 | HFTLKSDVLFNFNK (SEQ ID NO: 867) |
| | | 2231.16 | FGQGEAAPVVAPAPAPAPEVQTK (SEQ ID NO: 868) |
| | | 2599.35 | ATLKPEGQAALDQLYSQLSNLDPK (SEQ ID NO: 869) |
| | | 2600.29 | NHDTGVSPVFAGGVEYAITPEIATR (SEQ ID NO: 870) |
| | | 2670.29 | DGSVVVLGYTDRIGSDAYNQGLSER (SEQ ID NO: 871) |
| | | 3477.67 | LEYQWTNNIGDAHTIGTRPDNGMLSLGVSYR (SEQ ID NO: 872) |
| LW-1A-10 | 29 | 950.52 | ATNLLYTR (SEQ ID NO: 873) |
| | | 1019.54 | YAIVANDVR (SEQ ID NO: 874) |
| | | 1484.73 | TALIDHLDTMAER (SEQ ID NO: 875) |
| | | 1516.89 | QVIQFIDLSLITK (SEQ ID NO: 877) |
| | | 1675.81 | GANFIAVHEMLDGFR (SEQ ID NO: 878) |

[1]Molecular weight as determined by SDS-PAGE.
[2]The mass of a polypeptide fragment can be converted to m/z value by adding 1 to the mass. Each mass includes a range of plus or minus 300 ppm (the 83 kDa and 29 kDa polypeptides), 450 ppm (the 66 kDa and 56 kDa polypeptides), or 1 Dalton (the remaining polypeptide).

TABLE 7

Characteristics of polypeptides obtained from an *E. coli*.

| poly-peptide desig-nation | approximate molecular weight in kilodaltons (kDa)[1] | mass value of polypeptide fragments resulting from trypsin digest[2] | predicted amino acid sequence of the polypeptide fragment |
|---|---|---|---|
| AB1-1 | 92 | 904.51 | LVQLNYR (SEQ ID NO: 880) |
| | | 908.44 | GGIQYDTR (SEQ ID NO: 881) |
| | | 1050.50 | IYDDAAVER (SEQ ID NO: 882) |
| | | 1078.54 | EAPGQPEPVR (SEQ ID NO: 883) |
| | | 1171.60 | AQYLYVPYR (SEQ ID NO: 884) |
| | | 1276.56 | YGSSTDGYATQK (SEQ ID NO: 885) |
| | | 1343.65 | EEQVAEIWNAR (SEQ ID NO: 886) |
| | | 1403.73 | IYGQAVHFVNTR (SEQ ID NO: 887) |
| | | 1450.67 | RGNIMWENEFR (SEQ ID NO: 888) |
| | | 1479.76 | YASPEYIQATLPK (SEQ ID NO: 889) |
| | | 1510.72 | TGSLVWAGDTYWR (SEQ ID NO: 890) |
| | | 1546.66 | VSDPSYFNDFDNK (SEQ ID NO: 891) |
| | | 1567.75 | LDNVATSNSSIEYR (SEQ ID NO: 892) |
| | | 1624.79 | GLSSNYGLGTQEMLR (SEQ ID NO: 893) |

TABLE 7-continued

Characteristics of polypeptides obtained from an *E. coli.*

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 1668.72 | DTNVWEGDYQMVGR (SEQ ID NO: 895) |
| | | 1739.90 | NGISQVGAVASWPIADR (SEQ ID NO: 897) |
| | | 1822.89 | FNISVGQIYYFTESR (SEQ ID NO: 898) |
| | | 1858.93 | QHAVYDNAIGFNIELR (SEQ ID NO: 899) |
| | | 2122.02 | LLATHYQQTNLDWYNSR (SEQ ID NO: 900) |
| | | 2140.01 | IYNYDSSLLQSDYSGLFR (SEQ ID NO: 901) |
| AB1-2 | 80 | 628.39 | IEVLR (SEQ ID NO: 902) |
| | | 830.45 | DVSEIIR (SEQ ID NO: 903) |
| | | 1177.61 | AGTYATTLPAGR (SEQ ID NO: 904) |
| | | 1633.84 | NVSLTGGVDNLFDKR (SEQ ID NO: 905) |
| | | 1786.85 | TNFSLTGPLGDEFSFR (SEQ ID NO: 906) |
| | | 1796.82 | TQADAWDINQGHQSAR (SEQ ID NO: 907) |
| | | 1870.95 | APSLYQTNPNYILYSK (SEQ ID NO: 908) |
| | | 1980.96 | WDFAPLQSLELEAGYSR (SEQ ID NO: 909) |
| | | 2087.91 | QGNLYAGDTQNTNSDAYTR (SEQ ID NO: 910) |
| | | 2091.10 | LSIIPEYTLNSTLSWQAR (SEQ ID NO: 911) |
| | | 2173.92 | GSGEWHGSWDAYFNAPEHK (SEQ ID NO: 912) |
| | | 2302.02 | KGSGEWHGSWDAYFNAPEHK (SEQ ID NO: 913) |
| | | 2843.31 | AGNAQTTGDLAGANYIAGAGAYTYNEPGR (SEQ ID NO: 914) |
| AB1-3 | 77 | 1380.59 | SSEGANTYNEPGR (SEQ ID NO: 915) |
| | | 1525.72 | GDTNWVPPEQVER (SEQ ID NO: 916) |
| | | 1688.88 | ANFSLSGPLAGNALTTR (SEQ ID NO: 917) |
| | | 1748.79 | TNNTRMNEGLSGGGEGR (SEQ ID NO: 918) |
| | | 1831.90 | APNLYQSSEGYLLYSK (SEQ ID NO: 919) |
| | | 1889.03 | IVAGDNVIGQTASGAYILK (SEQ ID NO: 920) |
| | | 1929.04 | GPAAARYGSGAAGGVVNIITK (SEQ ID NO: 921) |
| | | 1968.03 | GMGPENTLILIDGVPVTSR (SEQ ID NO: 922) |
| | | 2030.93 | QNYGITHNGIWDWGQSR (SEQ ID NO: 924) |
| | | 2917.36 | QNYGITHNGIWDWGQSRFGVYYEK (SEQ ID NO: 925) |
| | | 2959.54 | NHSQISALYIEDNIEPVPGTNIIPGLR (SEQ ID NO: 926) |
| AB1-4 | 72 | 628.39 | IEVIR (SEQ ID NO: 927) |
| | | 807.40 | YWANVR (SEQ ID NO: 928) |
| | | 871.47 | QIWAAQR (SEQ ID NO: 929) |
| | | 888.44 | FVFEYGK (SEQ ID NO: 930) |
| | | 1738.77 | DKYNHWDLNYESR (SEQ ID NO: 931) |
| | | 1762.81 | LDNHEIYGSYWNPR (SEQ ID NO: 932) |
| | | 1872.93 | FGNSTTNDFYLSGPLIK (SEQ ID NO: 933) |
| | | 1999.02 | DVEGISITGGNEKPDISIR (SEQ ID NO: 934) |
| | | 2103.95 | SEDIDTIDGNWQVDEGRR (SEQ ID NO: 935) |
| | | 2141.02 | EVSPGFGTLTQGGASIMYGNR (SEQ ID NO: 936) |
| | | 2207.09 | DPVTGLNTFIYDNVGEANIR (SEQ ID NO: 937) |
| | | 2415.18 | ESRPNGSGGFEAGFIPPVEAIER (SEQ ID NO: 938) |
| | | 2439.29 | VTAFLPENVLTIGGQFQHAELR (SEQ ID NO: 939) |

TABLE 7-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| AB1-5 | 66 | 614.38 | VEIVR (SEQ ID NO: 940) |
| | | 715.38 | HFSIGR (SEQ ID NO: 941) |
| | | 770.48 | RVEIVR (SEQ ID NO: 942) |
| | | 830.38 | ASYFDTK (SEQ ID NO: 943) |
| | | 941.46 | IFVSYQW (SEQ ID NO: 944) |
| | | 951.48 | IYWSEVR (SEQ ID NO: 945) |
| | | 1025.62 | GVLVLVDGVR (SEQ ID NO: 946) |
| | | 1134.55 | IWGWDVMTK (SEQ ID NO: 947) |
| | | 1154.67 | DLPITLLGGTR (SEQ ID NO: 948) |
| | | 1221.63 | MSRPQFTSLR (SEQ ID NO: 949) |
| | | 1335.64 | DLLQEGQSSGFR (SEQ ID NO: 950) |
| | | 1395.64 | INAQNTGSSGEYR (SEQ ID NO: 951) |
| | | 1531.71 | EYWSPQGIPQDGR (SEQ ID NO: 952) |
| | | 1656.77 | FDDLMLSNDALEFK (SEQ ID NO: 953) |
| | | 1676.80 | YTTDLFSLDVAYNR (SEQ ID NO: 955) |
| | | 1716.88 | GTWQIDSAQSLSGLVR (SEQ ID NO: 956) |
| | | 1778.88 | IDFSSGWLQDEITLR (SEQ ID NO: 957) |
| | | 1962.95 | VFGTGGTGDHSLGLGASAFGR (SEQ ID NO: 958) |
| | | 1997.02 | QGTDTGHLNGTFLDPALIK (SEQ ID NO: 959) |
| | | 2261.08 | QPGYGVNDFYVSYQGQQALK (SEQ ID NO: 960) |
| | | 2397.13 | STLFADSFASHLLTYGGEYYR (SEQ ID NO: 961) |
| | | 3304.56 | FYTNYWVPNPNLRPETNETQEYGFGLR (SEQ ID NO: 962) |
| AB1-6 | 50 | 787.46 | SVVQTVR (SEQ ID NO: 963) |
| | | 801.43 | LSQDLAR (SEQ ID NO: 964) |
| | | 827.45 | LSNPELR (SEQ ID NO: 965) |
| | | 913.53 | NLSLLQAR (SEQ ID NO: 966) |
| | | 1179.55 | SAADRDAAFEK (SEQ ID NO: 967) |
| | | 1344.62 | TTTSNGHNPFRN (SEQ ID NO: 968) |
| | | 1736.92 | TIVDVLDATTTLYNAK (SEQ ID NO: 969) |
| | | 1828.90 | SSFNNINASISSINAYK (SEQ ID NO: 970) |
| | | 2033.96 | QAQYNFVGASEQLESAHR (SEQ ID NO: 971) |
| | | 2033.96 | QAQYNFVGASEQLESAHR (SEQ ID NO: 972) |
| | | 2183.09 | QITGNYYPELAALNVENFK (SEQ ID NO: 973) |
| | | 2183.09 | QITGNYYPELAALNVENFK (SEQ ID NO: 974) |
| | | 2184.09 | SPLLPQLGLGADYTYSNGYR (SEQ ID NO: 975) |
| | | 2226.06 | QAVVSAQSSLDAMEAGYSVGTR (SEQ ID NO: 976) |
| | | 2226.06 | QAVVSAQSSLDAMEAGYSVGTR (SEQ ID NO: 977) |
| AB1-7 | 42 | 631.37 | LSSGLR (SEQ ID NO: 978) |
| | | 708.38 | FTSNIK (SEQ ID NO: 979) |
| | | 715.40 | GLTQAAR (SEQ ID NO: 980) |
| | | 759.38 | LDEIDR (SEQ ID NO: 981) |
| | | 930.49 | SSLGAVQNR (SEQ ID NO: 982) |
| | | 1002.51 | SRLDEIDR (SEQ ID NO: 983) |

TABLE 7-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 1019.54 | AIAQVDTFR (SEQ ID NO: 984) |
| | | 2248.09 | LDSAVTNLNNTTTNLSEAQSR (SEQ ID NO: 985) |
| | | 2642.29 | NANDGISLAQTTEGALSEINNNLQR (SEQ ID NO: 986) |
| | | 2700.24 | GAATSQFVVQSGNDFYSASINHTDGK (SEQ ID NO: 987) |
| | | 2814.50 | VVVELSTAKPTAQFSGASSADPLALLDK (SEQ ID NO: 988) |
| AB1-8 | 38 | 704.42 | VAFAGLK (SEQ ID NO: 989) |
| | | 841.48 | NLGVINGR (SEQ ID NO: 990) |
| | | 884.41 | GNGFATYR (SEQ ID NO: 991) |
| | | 1289.57 | FQDVGSFDYGR (SEQ ID NO: 992) |
| | | 1438.68 | YVDVGATYYFNK (SEQ ID NO: 993) |
| | | 2353.10 | YDANNIYLAAQYTQTYNATR (SEQ ID NO: 994) |
| | | 2990.49 | AQNFEAVAQYQFDFGLRPSLAYLQSK (SEQ ID NO: 995) |
| AB1-9 | 36 | 718.44 | LAFAGLK (SEQ ID NO: 996) |
| | | 867.42 | DLGVHGDR (SEQ ID NO: 997) |
| | | 1057.56 | NAEVWAAGLK (SEQ ID NO: 998) |
| | | 1248.54 | FGDYGSIDYGR (SEQ ID NO: 999) |
| | | 1438.68 | YVDVGATYYFNK (SEQ ID NO: 1000) |
| | | 1933.77 | HYFSSNDADDGDTTYAR (SEQ ID NO: 1001) |
| | | 2217.05 | NNDFFGLVDGLNFAAQYQGK (SEQ ID NO: 1002) |
| | | 2389.09 | GETQINDQLTGFGQWEYEFK (SEQ ID NO: 1003) |
| | | 2834.36 | LGFKGETQINDQLTGFGQWEYEFK (SEQ ID NO: 1004) |
| AB1-10 | 35 | 817.43 | LGGMVWR (SEQ ID NO: 1005) |
| | | 871.51 | RVEIEVK (SEQ ID NO: 1007) |
| | | 1054.47 | DNTWYTGAK (SEQ ID NO: 1008) |
| | | 1279.64 | DGSVVVLGYTDR (SEQ ID NO: 1009) |
| | | 1377.76 | RAQSVVDYLISK (SEQ ID NO: 1010) |
| | | 1422.67 | IGSDAYNQALSER (SEQ ID NO: 1011) |
| | | 1639.81 | LGYPITDDLDVYTR (SEQ ID NO: 1012) |
| | | 2231.16 | FGQGEAAPVVAPAPAPAPEVQTK (SEQ ID NO: 1013) |
| | | 2599.35 | ATLKPEGQAALDQLYSQLSNLDPK (SEQ ID NO: 1014) |
| | | 3477.67 | LEYQWTNNIGDAHTIGTRPDNGMLSLGVSYR (SEQ ID NO: 1015) |
| AB1-11 | 30 | 706.34 | YWNPK (SEQ ID NO: 1016) |
| | | 776.48 | ILFVGTK (SEQ ID NO: 1017) |
| | | 929.52 | LENSLGGIK (SEQ ID NO: 1018) |
| | | 964.57 | VHIINLEK (SEQ ID NO: 1019) |
| | | 1065.58 | MKPFIFGAR (SEQ ID NO: 1020) |
| | | 1108.55 | AGVHFGHQTR (SEQ ID NO: 1022) |
| | | 1204.61 | WLGGMLTNWK (SEQ ID NO: 1023) |
| | | 1403.81 | AVTLYLGAVAATVR (SEQ ID NO: 1025) |
| | | 1560.82 | WLGGMLTNWKTVR (SEQ ID NO: 1026) |
| | | 1575.79 | TVPMFNEALAELNK (SEQ ID NO: 1027) |

TABLE 7-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment |
|---|---|---|---|
| | | 2376.17 | DMGGLPDALFVIDADHEHIAIK (SEQ ID NO: 1028) |
| Lw214 | 19 | 914.52 | ATVELLNR (SEQ ID NO: 1029) |
| | | 941.43 | QAHWNMR (SEQ ID NO: 1030) |
| | | 950.52 | ATNLLYTR (SEQ ID NO: 1031) |
| | | 1019.54 | YAIVANDVR (SEQ ID NO: 1032) |
| | | 1484.73 | TALIDHLDTMAER (SEQ ID NO: 1033) |
| | | 1516.89 | QVIQFIDLSLITK (SEQ ID NO: 1034) |
| | | 1603.83 | ELADRYAIVANDVR (SEQ ID NO: 1035) |
| | | 1675.81 | GANFIAVHEMLDGFR (SEQ ID NO: 1036) |
| | | 1677.85 | SYPLDIHNVQDHLK (SEQ ID NO: 1037) |
| | | 1677.85 | SYPLDIHNVQDHLK (SEQ ID NO: 1038) |
| | | 2413.39 | ATVELLNRQVIQFIDLSLITK (SEQ ID NO: 1039) |
| Lw215 | 16 | 602.30 | ELADR (SEQ ID NO: 1040) |
| | | 914.52 | ATVELLNR (SEQ ID NO: 1041) |
| | | 941.43 | QAHWNMR (SEQ ID NO: 1042) |
| | | 950.52 | ATNLLYTR (SEQ ID NO: 1043) |
| | | 1019.54 | YAIVANDVR (SEQ ID NO: 1044) |
| | | 1042.61 | KATVELLNR (SEQ ID NO: 1045) |
| | | 1147.63 | YAIVANDVRK (SEQ ID NO: 1046) |
| | | 1362.63 | DDDTADILTAASR (SEQ ID NO: 1047) |
| | | 1484.73 | TALIDHLDTMAER (SEQ ID NO: 1048) |
| | | 1516.89 | QVIQFIDLSLITK (SEQ ID NO: 1049) |
| | | 1603.83 | ELADRYAIVANDVR (SEQ ID NO: 1050) |
| | | 1675.81 | GANFIAVHEMLDGFR (SEQ ID NO: 1051) |
| | | 1767.87 | DLDKFLWFIESNIE (SEQ ID NO: 1052) |
| | | 1931.94 | AIGEAKDDDTADILTAASR (SEQ ID NO: 1053) |
| | | 2262.14 | SYPLDIHNVQDHLKELADR (SEQ ID NO: 1054) |

[1] Molecular weight as determined by SDS-PAGE.
[2] The mass of a polypeptide fragment can be converted to m/z value by adding 1 to the mass. Each mass includes a range of plus or minus 250 ppm (the 92 kDa polypeptide), plus or minus 300 ppm (the 80 kDa and 30 kDa polypeptides), plus or minus 400 ppm (the 77 kDa, 72 kDa, 42 kDa, and 35 kDa polypeptides), plus or minus 450 ppm (the 50 kDa and 36 kDa polypeptides), plus or minus 500 ppm (the 66 kDa and 38 kDa polypeptides) or 1 Dalton (the 19 kDa and 16 kDa polypeptides).

TABLE 8

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| J4-1 | 82 | 628.39 | IEVLR | (SEQ ID NO: 1055) |
| | | 1306.65 | DGWLAGVTWFR | (SEQ ID NO: 1056) |
| | | 1515.70 | GDTSWVPPEMIER | (SEQ ID NO: 1057) |
| | | 1577.83 | AETSINKEIGLEFK | (SEQ ID NO: 1058) |
| | | 1633.84 | NVSLTGGVDNLFDKR | (SEQ ID NO: 1059) |
| | | 1786.85 | TNFSLTGPLGDEFSFR | (SEQ ID NO: 1060) |
| | | 1796.82 | TQADAWDINQGHQSAR | (SEQ ID NO: 1061) |
| | | 1980.96 | WDFAPLQSLELEAGYSR | (SEQ ID NO: 1062) |
| | | 2087.91 | QGNLYAGDTQNTNSDAYTR | (SEQ ID NO: 1063) |
| | | 2091.10 | LSIIPEYTLNSTLSWQAR | (SEQ ID NO: 1064) |
| | | 2126.08 | GDTSWVPPEMIERIEVLR | (SEQ ID NO: 1065) |
| | | 2843.31 | AGNAQTTGDLAGANYIAGAGAYTYNEPGR | (SEQ ID NO: 1066) |
| J4-2 | 79 | 685.41 | ITLSPR | (SEQ ID NO: 1067) |
| | | 736.37 | NYWVR | (SEQ ID NO: 1068) |
| | | 841.51 | RITLSPR | (SEQ ID NO: 1069) |
| | | 860.45 | GIYAGQPR | (SEQ ID NO: 1070) |
| | | 1146.60 | IPGFMLWGAR | (SEQ ID NO: 1071) |
| | | 1207.57 | WQSTRPYDR | (SEQ ID NO: 1073) |
| | | 1243.56 | ENDVFEHAGAR | (SEQ ID NO: 1074) |
| | | 1278.57 | YLNESTHEMR | (SEQ ID NO: 1075) |
| | | 1472.74 | IDIGNWTITPGMR | (SEQ ID NO: 1076) |
| | | 1486.76 | FNIQGFYTQTLR | (SEQ ID NO: 1077) |
| | | 1578.82 | YGPQSVGGVVNFVTR | (SEQ ID NO: 1078) |
| | | 1615.78 | EDALTVVGDWLGDAR | (SEQ ID NO: 1079) |
| | | 1717.84 | LASLGYQFQPDSQHK | (SEQ ID NO: 1080) |

TABLE 8-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 2013.89 | ADYDADRWQSTRPYDR | (SEQ ID NO: 1081) |
| | | 2035.91 | YYTATSSGQLPSGSSPYDR | (SEQ ID NO: 1082) |
| | | 2110.03 | YSQIFMIGPSAHEVGVGYR | (SEQ ID NO: 1083) |
| J4-3 | 88 | 649.35 | GFSAIR | (SEQ ID NO: 1085) |
| | | 649.35 | GFSAIR | (SEQ ID NO: 1086) |
| | | 671.36 | IPGTER | (SEQ ID NO: 1087) |
| | | 820.42 | FTGNNLR | (SEQ ID NO: 1088) |
| | | 1123.53 | VDSYELGWR | (SEQ ID NO: 1089) |
| | | 1278.78 | GRPLVVLVDGVR | (SEQ ID NO: 1090) |
| | | 1296.65 | FYPFPTVNANK | (SEQ ID NO: 1091) |
| | | 1324.64 | IDDFIGYAQQR | (SEQ ID NO: 1092) |
| | | 1380.62 | SQGDDDYGLNLGK | (SEQ ID NO: 1093) |
| | | 1423.72 | IAGAVSGGNEHISGR | (SEQ ID NO: 1094) |
| | | 1550.73 | GTSTPFVSNGLNSDR | (SEQ ID NO: 1095) |
| | | 1702.85 | ATAYIGWAPDPWSLR | (SEQ ID NO: 1096) |
| | | 1731.80 | VQSTTSFDVSDAQGYK | (SEQ ID NO: 1097) |
| | | 2023.96 | APLYYSPGYGPASLYDYK | (SEQ ID NO: 1098) |
| | | 2019.88 | QVTAFSSSQQDTDQYGMK | (SEQ ID NO: 1099) |
| | | 2234.98 | GQPETMMEFEAGTKSGFSSSK | (SEQ ID NO: 1100) |
| | | 2785.41 | HLISLQYSDSAFLGQELVGQVYYR | (SEQ ID NO: 1101) |
| | | 2847.27 | FGGWFDGNGDATLLDNTQTGLQYSDR | (SEQ ID NO: 1102) |
| J4-4 | 60 | 675.33 | FEQPR | (SEQ ID NO: 1103) |
| | | 678.37 | VEYIR | (SEQ ID NO: 1104) |

TABLE 8-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 1755.80 | YDKDYSSYPYQTVK | (SEQ ID NO: 1105) |
| | | 1819.86 | QWEGAFEGLTAGVNWR | (SEQ ID NO: 1106) |
| | | 1892.00 | SAVYGSDAIGGVVNIITTR | (SEQ ID NO: 1107) |
| | | 1930.95 | QDIDRWQSTSVNDVLR | (SEQ ID NO: 1108) |
| | | 2023.92 | HGTWQTSAGWEFIEGYR | (SEQ ID NO: 1109) |
| | | 2158.14 | LPGVDITQNGGSGQLSSIFIR | (SEQ ID NO: 1110) |
| | | 2206.07 | APNLGQLYGFYGNPNLDPEK | (SEQ ID NO: 1111) |
| | | 2255.23 | LNLAGVSGSADLSQFPIALVQR | (SEQ ID NO: 1112) |
| | | 2323.11 | IANLFDKDYETVYGYQTAGR | (SEQ ID NO: 1113) |
| | | 2357.17 | NTGIYLTGLQQVGDFTFEGAAR | (SEQ ID NO: 1114) |
| | | 2698.25 | GVEATANFDTGPLTHTVSYDYVDAR | (SEQ ID NO: 1115) |
| J4-5 | 54 | 787.46 | SVVQTVR | (SEQ ID NO: 1116) |
| | | 801.43 | LSQDLAR | (SEQ ID NO: 1117) |
| | | 827.45 | LSNPELR | (SEQ ID NO: 1118) |
| | | 913.53 | NLSLLQAR | (SEQ ID NO: 1119) |
| | | 1230.57 | TTTSNGHNPFR | (SEQ ID NO: 1120) |
| | | 1284.64 | NNLDNAVEQLR | (SEQ ID NO: 1121) |
| | | 1322.76 | TDKPQPVNALLK | (SEQ ID NO: 1122) |
| | | 1344.62 | TTTSNGHNPFRN | (SEQ ID NO: 1123) |
| | | 1549.77 | AQYDTVLANEVTAR | (SEQ ID NO: 1124) |
| | | 1615.87 | FNVGLVAITDVQNAR | (SEQ ID NO: 1125) |
| | | 1736.92 | TIVDVLDATTTLYNAK | (SEQ ID NO: 1126) |
| | | 1828.90 | SSFNNINASISSINAYK | (SEQ ID NO: 1127) |

TABLE 8-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 2033.96 | QAQYNFVGASEQLESAHR | (SEQ ID NO: 1128) |
| | | 2123.10 | VGLSFSLPIYQGGMVNSQVK | (SEQ ID NO: 1129) |
| | | 2183.09 | QITGNYYPELAALNVENFK | (SEQ ID NO: 1130) |
| | | 2226.05 | QAVVSAQSSLDAMEAGYSVGTR | (SEQ ID NO: 1131) |
| J4-6 | 46 | 730.43 | LSLAATR | (SEQ ID NO: 1132) |
| | | 858.46 | LGQEVWK | (SEQ ID NO: 1133) |
| | | 963.46 | VDFHGYAR | (SEQ ID NO: 1134) |
| | | 1562.74 | FAYNINNNGHMLR | (SEQ ID NO: 1135) |
| | | 1660.77 | FVVQYATDSMTSQGK | (SEQ ID NO: 1137) |
| | | 1683.90 | NLIEWLPGSTIWAGK | (SEQ ID NO: 1138) |
| | | 1730.86 | DGWLFTAEHTQSVLK | (SEQ ID NO: 1139) |
| | | 2132.06 | LAQMEINPGGTLELGVDYGR | (SEQ ID NO: 1140) |
| | | 2209.07 | LGNECETYAELKLGQEVWK | (SEQ ID NO: 1142) |
| | | 2355.08 | WTPIMSTVMEIGYDNVESQR | (SEQ ID NO: 1143) |
| | | 3216.38 | SSEAGGSSSFASNNIYDYTNETANDVFDVR | (SEQ ID NO: 1145) |
| J4-7 | 45 | 785.41 | YALTYR | (SEQ ID NO: 1146) |
| | | 1024.46 | GNYSSDLNR | (SEQ ID NO: 1147) |
| | | 1029.51 | SISIPDQDR | (SEQ ID NO: 1148) |
| | | 1254.61 | ATSTSGDTLFQK | (SEQ ID NO: 1149) |
| | | 1496.68 | INEGPYQFESEGK | (SEQ ID NO: 1150) |
| | | 1504.74 | FWLSAGTTYAFNK | (SEQ ID NO: 1151) |
| | | 1586.77 | TGIAFDDSPVPAQNR | (SEQ ID NO: 1152) |
| | | 1651.74 | AYSGEGAIADDAGNVSR | (SEQ ID NO: 1153) |

TABLE 8-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 1777.83 | DASVDVGVSYMHGQSVK | (SEQ ID NO: 1154) |
| | | 1898.94 | LNNAWSFGLGFNAVYAR | (SEQ ID NO: 1155) |
| | | 1997.92 | IALGTTYYYDDNWTFR | (SEQ ID NO: 1156) |
| Lw216 | 38 | 867.44 | TTGVATYR | (SEQ ID NO: 1157) |
| | | 1248.54 | FGDYGSIDYGR | (SEQ ID NO: 1158) |
| | | 1438.68 | YVDVGATYYFNK | (SEQ ID NO: 1159) |
| | | 1933.77 | HYFSSNDADDGDTTYAR | (SEQ ID NO: 1160) |
| | | 2217.05 | NNDFFGLVDGLNFAAQYQGK | (SEQ ID NO: 1161) |
| | | 2389.09 | GETQINDQLTGFGQWEYEFK | (SEQ ID NO: 1162) |
| | | 2602.22 | NNDFFGLVDGLNFAAQYQGKNDR | (SEQ ID NO: 1163) |
| | | 2976.48 | AQNFEAVAQYQFDFGLRPSVAYLQSK | (SEQ ID NO: 1164) |
| | | 3306.53 | YDANNIYLATTYSETQNMTVFGNNHIANK | (SEQ ID NO: 1165) |
| Lw217 | 37 | 817.43 | LGGMVWR | (SEQ ID NO: 1166) |
| | | 1279.64 | DGSVVVLGYTDR | (SEQ ID NO: 1167) |
| | | 1377.69 | ADTKANVPGGASYK | (SEQ ID NO: 1168) |
| | | 2231.16 | FGQGEAAPVVAPAPAPAPEVQTK | (SEQ ID NO: 1169) |
| | | 2599.35 | ATLKPEGQAALDQLYSQLSNLDPK | (SEQ ID NO: 1170) |
| | | 2601.27 | DHDTGVSPVFAGGVEYAITPEIATR | (SEQ ID NO: 1171) |
| J4-11 | 31 | 706.34 | YWNPK | (SEQ ID NO: 1172) |
| | | 776.48 | ILFVGTK | (SEQ ID NO: 1173) |
| | | 929.52 | LENSLGGIK | (SEQ ID NO: 1174) |
| | | 964.57 | VHIINLEK | (SEQ ID NO: 1175) |

TABLE 8-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 1065.58 | MKPFIFGAR | (SEQ ID NO: 1176) |
| | | 1108.55 | AGVHFGHQTR | (SEQ ID NO: 1178) |
| | | 1204.61 | WLGGMLTNWK | (SEQ ID NO: 1179) |
| | | 1403.81 | AVTLYLGAVAATVR | (SEQ ID NO: 1181) |
| | | 1575.80 | TVPMFNEALAELNK | (SEQ ID NO: 1182) |
| | | 2376.17 | DMGGLPDALFVIDADHEHIAIK | (SEQ ID NO: 1184) |
| J4-12 | 30 | 716.40 | FGPQIR | (SEQ ID NO: 1185) |
| | | 1338.68 | LTNTDLSFGPFK | (SEQ ID NO: 1186) |
| | | 1462.66 | NDTYLEYEAFAK | (SEQ ID NO: 1187) |
| | | 1840.79 | EWYFANNYIYDMGR | (SEQ ID NO: 1188) |
| | | 1881.92 | GIWNHGSPLFMEIEPR | (SEQ ID NO: 1190) |
| | | 2262.94 | YQWQNYGAANENEWDGYR | (SEQ ID NO: 1192) |
| | | 2824.20 | YWHDGGQWNDDAELNFGNGNFNVR | (SEQ ID NO: 1193) |
| | | 2867.41 | TNNSIASSHILALNYDHWHYSVVAR | (SEQ ID NO: 1194) |
| Lw218 | 19 | 914.52 | ATVELLNR | (SEQ ID NO: 1195) |
| | | 941.43 | QAHWNMR | (SEQ ID NO: 1196) |
| | | 950.52 | ATNLLYTR | (SEQ ID NO: 1197) |
| | | 1019.54 | YAIVANDVR | (SEQ ID NO: 1198) |
| | | 1362.63 | DDDTADILTAASR | (SEQ ID NO: 1199) |
| | | 1484.73 | TALIDHLDTMAER | (SEQ ID NO: 1200) |
| | | 1516.89 | QVIQFIDLSLITK | (SEQ ID NO: 1201) |
| | | 1603.83 | ELADRYAIVANDVR | (SEQ ID NO: 1202) |
| | | 1675.81 | GANPIAVHEMLDGFR | (SEQ ID NO: 1203) |

TABLE 8-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 1677.85 | SYPLDIHNVQDHLK | (SEQ ID NO: 1204) |
| | | 1754.99 | AVQLGGVALGTTQVINSK | (SEQ ID NO: 1205) |
| | | 1931.94 | AIGEAKDDDTADILTAASR | (SEQ ID NO: 1206) |
| | | 2262.14 | SYPLDIHNVQDHLKELADR | (SEQ ID NO: 1207) |
| Lw219 | 16 | 602.30 | ELADR | (SEQ ID NO: 1208) |
| | | 914.52 | ATVELLNR | (SEQ ID NO: 1209) |
| | | 941.43 | QAHWNMR | (SEQ ID NO: 1210) |
| | | 950.52 | ATNLLYTR | (SEQ ID NO: 1211) |
| | | 1019.54 | YAIVANDVR | (SEQ ID NO: 1212) |
| | | 1042.61 | KATVELLNR | (SEQ ID NO: 1213) |
| | | 1147.63 | YAIVANDVRK | (SEQ ID NO: 1214) |
| | | 1362.63 | DDDTADILTAASR | (SEQ ID NO: 1215) |
| | | 1484.73 | TALIDHLDTMAER | (SEQ ID NO: 1216) |
| | | 1516.89 | QVIQFIDLSLITK | (SEQ ID NO: 1217) |
| | | 1603.83 | ELADRYAIVANDVR | (SEQ ID NO: 1218) |
| | | 1675.81 | GANFIAVHEMLDGFR | (SEQ ID NO: 1219) |
| | | 1754.99 | AVQLGGVALGTTQVINSK | (SEQ ID NO: 1220) |
| | | 1767.87 | DLDKFLWFIESNIE | (SEQ ID NO: 1221) |
| | | 1931.94 | AIGEAKDDDTADILTAASR | (SEQ ID NO: 1222) |
| | | 2262.14 | SYPLDIHNVQDHLKELADR | (SEQ ID NO: 1223) |

[1]Molecular weight as determined by SDS-PAGE.

[2]The mass of a polypeptide fragment can be converted to m/z value by adding 1 to the mass. Each mass includes a range of plus or minus 300 ppm (the 88 kDa, 79 kDa, 60 kDa, 38 kDa, and 31 kDa polypeptides), plus or minus 350 ppm (the 46 kDa polypeptide), plus or minus 400 ppm (the 82 kDa, 54 kDa, 45 kDa, and 30 kDa polypeptides), or plus or minus 1 Dalton (the 37 kDa, 19 kDa and 16 kDa polypeptides).

TABLE 9

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| Lw189A | 101 | 888.41 | YGYAYPR | (SEQ ID NO: 1224) |
| | | 986.54 | LAGDLETLR | (SEQ ID NO: 1225) |
| | | 998.45 | GYFPTDGSR | (SEQ ID NO: 1226) |
| | | 1008.47 | WGYGDGLGGK | (SEQ ID NO: 1227) |
| | | 1113.56 | DIHFEGLQR | (SEQ ID NO: 1228) |
| | | 1276.60 | GLEDFYYSVGK | (SEQ ID NO: 1229) |
| | | 1338.66 | ALFATGNFEDVR | (SEQ ID NO: 1230) |
| | | 1401.71 | VPGSPDQVDVVYK | (SEQ ID NO: 1231) |
| | | 1470.69 | DEVPWWNVVGDR | (SEQ ID NO: 1232) |
| | | 1519.80 | ERPTIASITFSGNK | (SEQ ID NO: 1233) |
| | | 1527.72 | LGFFETVDTDTQR | (SEQ ID NO: 1234) |
| | | 1698.85 | GIYVTVNITEGDQYK | (SEQ ID NO: 1235) |
| | | 1758.82 | YDGDKAEQFQFNIGK | (SEQ ID NO: 1236) |
| | | 1770.75 | TDDFTFNYGWTYNK | (SEQ ID NO: 1237) |
| | | 1953.86 | EMPFYENFYAGGSSTVR | (SEQ ID NO: 1238) |
| | | 2145.04 | SYGTDVTLGFPINEYNSLR | (SEQ ID NO: 1239) |
| | | 2154.96 | TDDFTFNYGWTYNKLDR | (SEQ ID NO: 1240) |
| | | 2238.15 | LSGVEVSGNLAGHSAEIEQLTK | (SEQ ID NO: 1241) |
| | | 2253.97 | LFYNDFQADDADLSDYTNK | (SEQ ID NO: 1242) |
| | | 2911.42 | LGFFETVDTDTQRVPGSPDQVDVVYK | (SEQ ID NO: 1243) |
| Lw189B | 101 | 904.51 | LVQLNYR | (SEQ ID NO: 1244) |
| | | 1171.60 | AQYLYVPYR | (SEQ ID NO: 1245) |
| | | 1276.56 | YGSSTDGYATQK | (SEQ ID NO: 1246) |
| | | 1294.58 | GNIMWENEFR | (SEQ ID NO: 1247) |

TABLE 9-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 1307.68 | LQADEVQLHQK | (SEQ ID NO: 1248) |
| | | 1343.65 | EEQVAEIWNAR | (SEQ ID NO: 1249) |
| | | 1403.73 | IYGQAVHFVNTR | (SEQ ID NO: 1250) |
| | | 1450.68 | RGNIMWENEFR | (SEQ ID NO: 1251) |
| | | 1546.66 | VSDPSYFNDFDNK | (SEQ ID NO: 1252) |
| | | 1668.72 | DTNVWEGDYQMVGR | (SEQ ID NO: 1253) |
| | | 1717.73 | VYEDEHPNDDSSRR | (SEQ ID NO: 1254) |
| | | 1763.82 | WSIVGAYYYDTNANK | (SEQ ID NO: 1255) |
| | | 1822.89 | FNISVGQIYYFTESR | (SEQ ID NO: 1256) |
| | | 1831.91 | FSVGYAVQNFNATVSTK | (SEQ ID NO: 1257) |
| | | 1858.93 | QHAVYDNAIGFNIELR | (SEQ ID NO: 1258) |
| | | 2013.02 | TVDALGNVHYDDNQVILK | (SEQ ID NO: 1259) |
| | | 2088.13 | VGPVPIFYSPYLQLPVGDK | (SEQ ID NO: 1260) |
| Lw190 | 88 | 1177.61 | AGTYATTLPAGR | (SEQ ID NO: 1261) |
| | | 1177.61 | AGTYATTLPAGR | (SEQ ID NO: 1262) |
| | | 1306.65 | DGWLAGVTWFR | (SEQ ID NO: 1263) |
| | | 1515.70 | GDTSWVPPEMIER | (SEQ ID NO: 1264) |
| | | 1577.83 | AETSINKEIGLEFK | (SEQ ID NO: 1265) |
| | | 1633.84 | NVSLTGGVDNLFDKR | (SEQ ID NO: 1266) |
| | | 1786.85 | TNFSLTGPLGDEFSFR | (SEQ ID NO: 1267) |
| | | 1796.82 | TQADAWDINQGHQSAR | (SEQ ID NO: 1268) |
| | | 1870.95 | APSLYQTNPNYILYSK | (SEQ ID NO: 1269) |
| | | 1980.96 | WDFAPLQSLELEAGYSR | (SEQ ID NO: 1270) |
| | | 2126.08 | GDTSWVPPEMIERIEVLR | (SEQ ID NO: 1271) |
| | | 2173.92 | GSGEWHGSWDAYFNAPEHK | (SEQ ID NO: 1272) |

TABLE 9-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 2302.02 | KGSGEWHGSWDAYFNAPEHK | (SEQ ID NO: 1273) |
| | | 2706.33 | IEAGYVAVGQNAVGTDLYQWDNVPK | (SEQ ID NO: 1274) |
| | | 2843.31 | AGNAQTTGDLAGANYIAGAGAYTYNEPGR | (SEQ ID NO: 1275) |
| | | 3081.49 | FDHHSIVGNNWSPALNISQGLGDDFTLK | (SEQ ID NO: 1276) |
| | | 3196.44 | QNYALTWNGGWDNGVTTSNWVQYEHTR | (SEQ ID NO: 1277) |
| Lw191 | 85 | 564.28 | FWGR | (SEQ ID NO: 1278) |
| | | 685.41 | ITLSPR | (SEQ ID NO: 1279) |
| | | 736.37 | NYWVR | (SEQ ID NO: 1280) |
| | | 860.45 | GIYAGQPR | (SEQ ID NO: 1281) |
| | | 861.43 | TWELGTR | (SEQ ID NO: 1282) |
| | | 1146.60 | IPGFMLWGAR | (SEQ ID NO: 1283) |
| | | 1207.57 | WQSTRPYDR | (SEQ ID NO: 1284) |
| | | 1243.56 | ENDVFEHAGAR | (SEQ ID NO: 1285) |
| | | 1278.57 | YLNESTHEMR | (SEQ ID NO: 1286) |
| | | 1278.57 | YLNESTHEMR | (SEQ ID NO: 1287) |
| | | 1329.64 | NIFDQDYFIR | (SEQ ID NO: 1288) |
| | | 1486.76 | FNIQGFYTQTLR | (SEQ ID NO: 1289) |
| | | 1578.82 | YGPQSVGGVVNFVTR | (SEQ ID NO: 1290) |
| | | 1615.78 | EDALTVVGDWLGDAR | (SEQ ID NO: 1291) |
| | | 1650.83 | EKGDTYGNLVPFSPK | (SEQ ID NO: 1292) |
| | | 1696.78 | SYDDNNKGIYAGQPR | (SEQ ID NO: 1293) |
| | | 1717.84 | LASLGYQFQPDSQHK | (SEQ ID NO: 1294) |
| | | 2013.89 | ADYDADRWQSTRPYDR | (SEQ ID NO: 1295) |

TABLE 9-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 2035.91 | YYTATSSGQLPSGSSPYDR | (SEQ ID NO: 1296) |
| | | 2110.03 | YSQIFMIGPSAHEVGVGYR | (SEQ ID NO: 1297) |
| | | 2221.11 | ALNQYAAHSGFTLSVDASLTR | (SEQ ID NO: 1298) |
| | | 2408.09 | YYTATSSGQLPSGSSPYDRDTR | (SEQ ID NO: 172) |
| | | 2581.22 | ETHNLMVGGTADNGFGTALLYSGTR | (SEQ ID NO: 1299) |
| | | 2683.31 | AIPQDFGIEAGVEGQLSPTSSQNNPK | (SEQ ID NO: 1300) |
| | | 2946.40 | SGTEAHAWYLDDKIDIGNWTITPGMR | (SEQ ID NO: 1301) |
| | | 3021.50 | YDLGTLTPTLDNVSIYASYAYVNAEIR | (SEQ ID NO: 1302) |
| | | 3144.41 | YAPDEVHTFNSLLQYYDGEADMPGGLSR | (SEQ ID NO: 1303) |
| Lw193 | 77 | 523.26 | YDVK | (SEQ ID NO: 1304) |
| | | 649.35 | GFSAIR | (SEQ ID NO: 1305) |
| | | 820.42 | FTGNNLR | (SEQ ID NO: 1306) |
| | | 1123.53 | VDSYELGWR | (SEQ ID NO: 1307) |
| | | 1159.59 | TFGLNYSVLF | (SEQ ID NO: 1308) |
| | | 1278.78 | GRPLVVLVDGVR | (SEQ ID NO: 1309) |
| | | 1296.65 | FYPFPTVNANK | (SEQ ID NO: 1310) |
| | | 1324.64 | IDDFIGYAQQR | (SEQ ID NO: 1311) |
| | | 1372.71 | GRTFGLNYSVLF | (SEQ ID NO: 1312) |
| | | 1380.62 | SQGDDDYGLNLGK | (SEQ ID NO: 1313) |
| | | 1423.72 | IAGAVSGGNEHISGR | (SEQ ID NO: 1314) |
| | | 1509.83 | GIYGAAVNGHLPLTK | (SEQ ID NO: 1315) |
| | | 1550.73 | GTSTPFVSNGLNSDR | (SEQ ID NO: 1316) |
| | | 1553.84 | DALAQLIPGLDVSSR | (SEQ ID NO: 1317) |

TABLE 9-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 1649.84 | LEGVKVDSYELGWR | (SEQ ID NO: 1318) |
| | | 1702.85 | ATAYIGWAPDPWSLR | (SEQ ID NO: 1319) |
| | | 1924.06 | ELKDALAQLIPGLDVSSR | (SEQ ID NO: 1320) |
| | | 2013.00 | QQAWLNFSQGVELPDPGK | (SEQ ID NO: 1321) |
| | | 2023.96 | APLYYSPGYGPASLYDYK | (SEQ ID NO: 1322) |
| | | 2204.08 | GTSTPFVSNGLNSDRIPGTER | (SEQ ID NO: 1323) |
| | | 2251.05 | YQYTENKIDDFIGYAQQR | (SEQ ID NO: 1324) |
| | | 2552.24 | QQAWLNFSQGVELPDPGKYYGR | (SEQ ID NO: 1325) |
| | | 2785.41 | HLISLQYSDSAFLGQELVGQVYYR | (SEQ ID NO: 1326) |
| | | 2847.27 | FGGWFDGNGDATLLDNTQTGLQYSDR | (SEQ ID NO: 1327) |
| | | 3194.53 | ATSADAIPGGSVDYDNFLFNAGLLMHITER | (SEQ ID NO: 1328) |
| | | 3335.65 | YPSYDITNLAAFLQSGYDINNLFTLNGGVR | (SEQ ID NO: 1329) |
| | | 3385.69 | HLISLQYSDSAFLGQELVGQVYYRDESLR | (SEQ ID NO: 1330) |
| Lw194 | 67 | 678.37 | VEYIR | (SEQ ID NO: 1331) |
| | | 1112.62 | NAITDTPLLR | (SEQ ID NO: 1332) |
| | | 1135.55 | FIASYGTSYK | (SEQ ID NO: 1333) |
| | | 1243.71 | STVLAPTTVVTR | (SEQ ID NO: 1334) |
| | | 1249.63 | SQLITSYSHSK | (SEQ ID NO: 1335) |
| | | 1294.63 | LYSQSWDAGLR | (SEQ ID NO: 1336) |
| | | 1298.53 | DYNYDPHYGR | (SEQ ID NO: 1337) |
| | | 1303.65 | WQSTSVNDVLR | (SEQ ID NO: 1338) |
| | | 1349.61 | DYSSYPYQTVK | (SEQ ID NO: 1339) |

TABLE 9-continued

Characteristics of polypeptides obtained from an *E. coli*.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 1422.73 | KLYSQSWDAGLR | (SEQ ID NO: 1340) |
| | | 1521.67 | DYETVYGYQTAGR | (SEQ ID NO: 1341) |
| | | 1549.86 | GTNASHVLVLIDGVR | (SEQ ID NO: 1342) |
| | | 1755.80 | YDKDYSSYPYQTVK | (SEQ ID NO: 1343) |
| | | 1761.81 | NDVSDLIDYDDHTLK | (SEQ ID NO: 1344) |
| | | 1886.83 | QTTTPGTGYVEDGYDQR | (SEQ ID NO: 1345) |
| | | 1892.00 | SAVYGSDAIGGVVNIITTR | (SEQ ID NO: 1346) |
| | | 1931.89 | TNYDAYYSPGSPLLDTR | (SEQ ID NO: 1347) |
| | | 2023.92 | HGTWQTSAGWEFIEGYR | (SEQ ID NO: 1348) |
| | | 2158.14 | LPGVDITQNGGSGQLSSIFIR | (SEQ ID NO: 1349) |
| | | 2206.07 | APNLGQLYGFYGNPNLDPEK | (SEQ ID NO: 1350) |
| | | 2255.23 | LNLAGVSGSADLSQFPIALVQR | (SEQ ID NO: 1351) |
| | | 2323.11 | IANLFDKDYETVYGYQTAGR | (SEQ ID NO: 12) |
| Lw195 | 38 | 1057.56 | NAEVWAAGLK | (SEQ ID NO: 20) |
| | | 1248.54 | FGDYGSIDYGR | (SEQ ID NO: 584) |
| | | 1438.68 | YVDVGATYYFNK | (SEQ ID NO: 591) |
| | | 1933.77 | HYFSSNDADDGDTTYAR | (SEQ ID NO: 595) |
| | | 1960.03 | TDTQVNAGKVLPEVFASGK | (SEQ ID NO: 690) |
| | | 2217.05 | NNDFFGLVDGLNFAAQYQGK | (SEQ ID NO: 693) |
| | | 2389.09 | GETQINDQLTGFGQWEYEFK | (SEQ ID NO: 698) |
| | | 2976.48 | AQNFEAVAQYQFDFGLRPSVAYLQSK | (SEQ ID NO: 773) |
| | | 3340.53 | YDANNIYLATTYSETQNMTVFADSFVANK | (SEQ ID NO: 876) |
| | | 3549.48 | SDFDNYTEGNGDGFGFSATYEYEGFGIGATYAK | (SEQ ID NO: 879) |
| Lw196 | 35 | 644.36 | HFTLK | (SEQ ID NO: 894) |
| | | 817.43 | LGGMVWR | (SEQ ID NO: 896) |
| | | 871.51 | RVEIEVK | (SEQ ID NO: 923) |

TABLE 9-continued

Characteristics of polypeptides obtained from an E. coli.

| polypeptide designation | approximate molecular weight in kilodaltons (kDa)[1] | mass value of polypeptide fragments resulting from trypsin digest[2] | predicted amino acid sequence of the polypeptide fragment | |
|---|---|---|---|---|
| | | 914.52 | AQGVQLTAK | (SEQ ID NO: 954) |
| | | 1054.47 | DNTWYTGAK | (SEQ ID NO: 1006) |
| | | 1082.54 | SDVLFNFNK | (SEQ ID NO: 1021) |
| | | 1154.63 | GIKDVVTQPQA | (SEQ ID NO: 1024) |
| | | 1213.61 | AALIDCLAPDR | (SEQ ID NO: 1072) |
| | | 1221.66 | AQSVVDYLISK | (SEQ ID NO: 1084) |
| | | 1232.63 | LGGMVWRADTK | (SEQ ID NO: 1136) |
| | | 1279.64 | DGSVVVLGYTDR | (SEQ ID NO: 1141) |
| | | 1369.71 | AALIDCLAPDRR | (SEQ ID NO: 1144) |
| | | 1377.76 | RAQSVVDYLISK | (SEQ ID NO: 1177) |
| | | 1408.66 | IGSDAYNQGLSER | (SEQ ID NO: 1180) |
| | | 1653.82 | LGYPITDDLDIYTR | (SEQ ID NO: 1183) |
| | | 2062.92 | GMGESNPVTGNTCDNVKQR | (SEQ ID NO: 1189) |
| | | 2231.16 | FGQGEAAPVVAPAPAPAPE VQTK | (SEQ ID NO: 1191) |
| | | 2600.29 | NHDTGVSPVFAGGVEYAIT PEIATR | (SEQ ID NO: 173) |
| | | 3477.67 | LEYQWTNNIGDAHTIGTRP DNGMLSLGVSYR | (SEQ ID NO: 179) |

[1]Molecular weight as determined by SDS-PAGE.
[2]The mass of a polypeptide fragment can be converted to m/z value by adding 1 to the mass. Each mass includes a range of plus or minus 150 ppm (the 38 kDa and 35 kDa polypeptide), plus or minus 300 ppm (the 101 kDa polypeptides), or plus or minus 1 Dalton (the 88 kDa, 85 kDa, 77 kDa, and 67 kDa polypeptides).

In yet another aspect, the present invention further includes polypeptides having similarity with an amino acid sequence. The similarity is referred to as structural similarity and is generally determined by aligning the residues of the two amino acid sequences (i.e., a candidate amino acid sequence and a reference amino acid sequence) to optimize the number of identical amino acids along the lengths of their sequences; gaps in either or both sequences are permitted in making the alignment in order to optimize the number of identical amino acids, although the amino acids in each sequence must nonetheless remain in their proper order. Reference amino acid sequences are disclosed in Tables 10, 11, 12, 13, 14, 15, 16, and 17. Two amino acid sequences can be prepared using commercially available algorithms. Preferably, two amino acid sequences are compared using the Blastp program of the BLAST 2 search algorithm, as described by Tatusova, et al., (*FEMS Microbiol Lett* 1999, 174:247-250). Preferably, the default values for all BLAST 2 search parameters are used, including matrix=BLOSUM62; open gap penalty=11, extension gap penalty=1, gap x_dropoff=50, expect=10, word-size=3, and optionally, filter on. In the comparison of two amino acid sequences using the BLAST search algorithm, structural similarity is referred to as "identities." Preferably, a candidate amino acid sequence has at least 95% identity, at least 96% identity, at least 97% identity, at least 98% identity, or at least 99% identity to a reference amino acid sequence. Preferably, the molecular weight of the candidate amino acid sequence and the reference amino acid sequence are substantially the same value. Preferably, the molecular weight of the candidate amino acid sequence and the reference amino acid sequence is determined by SDS polyacrylamide gel electrophoresis. A candidate polypeptide can be obtained by growth of a microbe under low metal conditions and the subsequent isolation of a polypeptide by the procedures disclosed herein.

Typically, a candidate amino acid sequence having structural similarity to a reference amino acid sequence has seroreactive activity. As used herein, "seroreactive activity" refers to the ability of a candidate polypeptide to react with antibody present in convalescent serum from an animal infected with an *S. enterica* serovar Newport (preferably, MS020508, ATCC Accession No. PTA-9496), an *S. enterica* serovar Enteritidis (preferably, MS010531), an *S. enterica* serovar Typhimurium (preferably, MS010427), an *S. enterica* serovar Dublin (preferably, IRP SDC Serial), or an *E. coli* (preferably, BEcO157(stx−), MS040330, MS040324, or MS040827). Preferably, when the candidate polypeptide is compared to a reference polypeptide from table 10, 11, 12, 13, 14, 15, 16, or 17, the convalescent serum is from an animal infected with MS020508 (ATCC Accession No. PTA-9496), MS010531, MS010427, IRP SDC Serial, BEcO157(stx−), MS040330, MS040324, or MS040827, respectively.

TABLE 10

*S. enterica* serovar Newport

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 82 | 25300748 | 12 | 1367 |
| 80 | 20196197 | 13 | 1368 |
| 74 | 25300749 | 14 | 1369 |
| 65 | 16767394 | 15 | 1370 |
| 56 | 1706868 | 16 | 1371 |
| 55 | 16226009 | 17 | 1372 |
| 52 | 25298420 | 18 | 1373 |
| 45 | 1941972 | 19 | 1374 |
| 38 | 16420094 | 20 | 1375 |
| 38 | 7428872 | 21 | 1376 |
| 36 | 25298549 | 22 | 1377 |
| 22 | 7162107 | 23 | 1378 |
| 18 | 25301837 | 24 | 1379 |
| 12 | 25298585 | 25 | 1380 |

TABLE 11

*S. enterica* serovar Enteritidis

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 92 | 29136388 | 93 | 1381 |
| 91 | 25008880 | 26 | 1382 |
| 86 | 16419095 | 27 | 1383 |
| 83 | 20196197 | 28 | 1384 |
| 78 | 29136792 | 29 | 1385 |
| 55 | 29139082 | 30 | 1386 |
| 40 | 19743622 | 31 | 1387 |
| 39 | 17865737 | 32 | 1388 |
| 38 | 20141670 | 33 | 1389 |

TABLE 12

*S. enterica* serovar Typhimurium

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 86 | 29138313 | 34 | 1390 |
| 82 | 16421325 | 35 | 1391 |
| 77 | 29136792 | 36 | 1392 |
| 40 | 16761195 | 37 | 1393 |
| 39 | 17865737 | 38 | 1394 |
| 38 | 20141670 | 39 | 1395 |

TABLE 13

*S. enterica* serovar Dublin

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 96 | 16419095 | 40 | 1396 |
| 89 | 16421325 | 41 | 1397 |
| 81 | 16765529 | 42 | 1398 |
| 61 | 479267 | 43 | 1399 |
| 56 | 2495191 | 44 | 1400 |
| 51 | 531889 | 45 | 1401 |
| 43 | 16764533 | 46 | 1402 |
| 40 | 47797 | 47 | 1403 |
| 38 | 16764429 | 48 | 1404 |

TABLE 14

*E. coli*

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 90 | 25300745 | 49 | 1405 |
| 86 | 15799834 | 50 | 1406 |
| 83 | 3661500 | 51 | 1407 |
| 79 | 1655877 | 52 | 1408 |
| 66 | 12516024 | 53 | 1409 |
| 66 | 15804564 | 54 | 1410 |
| 56 | 15803582 | 55 | 1411 |
| 38 | 25298428 | 56 | 1412 |
| 37 | 25298543 | 57 | 1413 |
| 29 | 232021 | 58 | 1414 |

TABLE 15

*E. coli*

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 92 | 26106377 | 59 | 1415 |
| 80 | 26106960 | 60 | 1416 |
| 77 | 25987939 | 61 | 1417 |
| 72 | 26250982 | 62 | 1418 |
| 66 | 13363854 | 63 | 1419 |
| 50 | 15803582 | 64 | 1420 |
| 42 | 6009835 | 65 | 1421 |

TABLE 15-continued E. coli

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 38 | 6650193 | 66 | 1422 |
| 36 | 26107830 | 67 | 1423 |
| 35 | 7188818 | 68 | 1424 |
| 30 | 26246115 | 69 | 1425 |
| 19 | 3660175 | 70 | 1426 |
| 16 | 232021 | 71 | 1427 |

TABLE 16

E. coli

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 82 | 26106960 | 72 | 1428 |
| 79 | 7429053 | 73 | 1429 |
| 88 | 78355 | 74 | 1430 |
| 60 | 7429052 | 75 | 1431 |
| 54 | 15803582 | 76 | 1432 |
| 46 | 3114532 | 77 | 1433 |
| 45 | 1799743 | 78 | 1434 |
| 38 | 26107830 | 79 | 1435 |
| 37 | 37624562 | 80 | 1436 |
| 31 | 1552746 | 81 | 1437 |
| 30 | 25348404 | 82 | 1438 |
| 19 | 3660175 | 83 | 1439 |
| 16 | 232021 | 84 | 1440 |

TABLE 17

E. coli

| Molecular weight of reference polypeptide (kDa) | NCBI sequence identifier of polypeptide identified by the computer algorithm as having best match to mass fingerprint of reference polypeptide | FIGURE | SEQ ID NO: |
|---|---|---|---|
| 101 | 21307716 | 85 | 1441 |
| 101 | 7430186 | 86 | 1442 |
| 88 | 6730010 | 87 | 1443 |
| 85 | 7429053 | 88 | 1444 |
| 77 | 38016693 | 89 | 1445 |
| 67 | 7429052 | 90 | 1446 |
| 38 | 33112659 | 91 | 1447 |
| 35 | 72585 | 92 | 1448 |

Also provided by the present invention are whole cell preparations of a microbe, where the microbe expresses one or more of the polypeptides of the present invention. The cells present in a whole cell preparation are preferably inactivated such that the cells cannot replicate, but the immunogenic activity of the polypeptides of the present invention expressed by the microbe is maintained. Typically, the cells are killed by exposure to agents such as glutaraldehyde, formalin, or formaldehyde.

Compositions

A composition of the present invention may include at least one polypeptide described herein, or a number of polypeptides that is an integer greater than 1 (e.g., at least 2, at least 3, at least 4, etc.) up to 15. A composition can include polypeptides obtainable from 1 microbe, or can be obtainable from a combination of 2 or more microbes. For instance, a composition can include polypeptides obtainable from 2 or more E. coli strains, or from 1 or more E. coli and 1 or more Salmonella spp.

Optionally, a polypeptide of the present invention can be covalently bound to a carrier polypeptide to improve the immunological properties of the polypeptide. Useful carrier polypeptides are known to the art. The chemical coupling of a polypeptide of the present invention can be carried out using known and routine methods. For instance, various homobifunctional and/or heterobifunctional cross-linker reagents such as bis(sulfosuccinimidyl) suberate, bis(diazobenzidine), dimethyl adipimidate, dimethyl pimelimidate, dimethyl superimidate, disuccinimidyl suberate, glutaraldehyde, m-maleimidobenzoyl-N-hydroxysuccinimide, sulfo-m-maleimidobenzoyl-N-hydroxysuccinimide, sulfosuccinimidyl 4-(N-maleimidomethyl)cycloheane-1-carboxylate, sulfosuccinimidyl 4-(p-maleimido-phenyl)butyrate and (1-ethyl-3-(dimethyl-aminopropyl) carbodiimide can be used (Harlow and Lane, Antibodies, A Laboratory Manual, generally and Chapter 5, Cold Spring Harbor Laboratory, Cold Spring Harbor, New York, N.Y. (1988)).

Preferably, such compositions of the present invention include low concentrations of lipopolysaccharide (LPS). LPS is a component of the outer membrane of most gram negative microbes (see, for instance, Nikaido and Vaara, Outer Membrane, In: Escherichia coli and Salmonella typhimurium, Cellular and Molecular Biology, Neidhardt et al., (eds.) American Society for Microbiology, Washington, D.C., pp. 7-22 (1987), and typically includes polysaccharides (O-specific chain, the outer and inner core) and the lipid A region. The lipid A component of LPS is the most biologically active component of the LPS structure and together induce a wide spectrum of pathophysiological effects in mammals. The most dramatic effects are fever, disseminated intravascular coagulation, complement activation, hypotensive shock, and death. The non-specific immunostimulatory activity of LPS can enhance the formation of a granuloma at the site of administration of compositions that include LPS. Such reactions can result in undue stress on the animal by which the animal may back off feed or water for a period of time, and exasperate infectious conditions in the animal. In addition, the formation of a granuloma at the site of injection can increase the likelihood of possible down grading of the carcass due to scaring or blemishes of the tissue at the injection site (see, for instance, Rae, Injection Site Reactions, available at www.animal.ufl.edu/short94/rae.htm).

The concentration of LPS can be determined using routine methods known to the art. Such methods typically include measurement of dye binding by LPS (see, for instance, Keler and Nowotny, Analyt. Biochem., 156, 189-193 (1986)) or the use of a Limulus amebocyte lysate (LAL) test (see, for instance, Endotoxins and Their Detection With the Limulus Amebocyte Lysate Test, Watson et al., (eds.), Alan R. Liss, Inc., 150 Fifth Avenue, New York, N.Y. (1982)). There are four basic commercially available methods that are typically used with an LAL test: the gel-clot test; the turbidimetric (spectrophotometric) test; the colorimetric test; and the chromogenic test. An example of a gel-clot assay is available under the tradename E-TOXATE (Sigma Chemical Co., St. Louis, Mo.; see Sigma Technical Bulletin No. 210), and PYROTELL (Associates of Cape Cod, Inc., East Falmouth, Mass.). Typically, assay conditions include contacting the composition with a preparation containing a lysate of the circulating amebocytes of the horseshoe crab, Limulus polyphemus. When exposed to LPS, the lysate increases in opacity as well as viscosity and may gel. About 0.1 milliliter of the composition is added to lysate. Typically, the pH of the composition is between 6 and 8, preferably, between 6.8 and 7.5. The mixture of composition and lysate is incubated for about 1 hour undisturbed at about 37° C. After incubation, the mixture is observed to determine if there was gelation of the mixture. Gelation indicates the presence of endotoxin. To determine the amount of endotoxin present in the composition, dilutions of a standardized solution of endotoxin are made and tested at the same time that the composition is tested. Standardized solutions of endotoxin are commercially available from, for instance, Sigma Chemical (Catalog No. 210-SE), U.S. Pharmacopeia (Rockville, Md., Catalog No. 235503), and Associates of Cape Cod, Inc., (Catalog No. E0005). In general, when a composition of the present invention is prepared by isolating polypeptides from a microbe by a method as described herein (e.g., a method that includes disrupting and solubilizing the cells, and collecting the insoluble polypeptides), the amount of LPS in a composition of the present invention is less than the amount of LPS present in a mixture of the same amount of the microbe that has been disrupted under the same conditions but not solubilized. Typically, the level of LPS in a composition of the present invention is decreased by, in increasing order of preference, at least 50%, at least 60%, at least 70%, at least 80%, or at least 90% relative to the level of LPS in a composition prepared by disrupting, but not solubilizing, the same microbe.

The present invention also provides compositions including a whole cell preparation of at least 1 *Salmonella* spp., at least about 1 *E. coli*, or the combination thereof. In some aspects, a composition can include whole preparations from 2, 3, 4, 5, or 6 *E. coli* strains.

The compositions of the present invention optionally further include a pharmaceutically acceptable carrier. "Pharmaceutically acceptable" refers to a diluent, carrier, excipient, salt, etc, that is compatible with the other ingredients of the composition, and not deleterious to the recipient thereof. Typically, the composition includes a pharmaceutically acceptable carrier when the composition is used as described herein. The compositions of the present invention may be formulated in pharmaceutical preparations in a variety of forms adapted to the chosen route of administration, including routes suitable for stimulating an immune response to an antigen. Thus, a composition of the present invention can be administered via known routes including, for example, oral; parental including intradermal, subcutaneous, intramuscular, intravenous, intraperitoneal, etc., and topically, such as, intranasal, intrapulmonary, intramammary, intravaginal, intrauterine, intradermal, and rectally etc. It is foreseen that a composition can be administered to a mucosal surface, such as by administration to the nasal or respiratory mucosa (e.g. spray or aerosol), to stimulate mucosal immunity, such as production of secretory IgA antibodies, throughout the animal's body.

A composition of the present invention can also be administered via a sustained or delayed release implant. Implants suitable for use according to the invention are known and include, for example, those disclosed in Emery and Straub (WO 01/37810 (2001)), and Emery et al., (WO 96/01620 (1996)). Implants can be produced at sizes small enough to be administered by aerosol or spray. Implants also include nanospheres and microspheres.

A composition of the present invention is administered in an amount sufficient to treat certain conditions as described herein. The amount of polypeptides or whole cells present in a composition of the present invention can vary. For instance, the dosage of polypeptides can be between 0.01 micrograms ($\mu$g) and 300 mg, typically between 0.1 mg and 10 mg. When the composition is a whole cell preparation, the cells can be present at a concentration of $10^6$ bacteria/ml, $10^7$ bacteria/ml, $10^8$ bacteria/ml, or $10^9$ bacteria/ml. For an injectable composition (e.g. subcutaneous, intramuscular, etc.) the polypeptides may be present in the composition in an amount such that the total volume of the composition administered is 0.5 ml to 5.0 ml, typically 1.0-2.0 ml. When the composition is a whole cell preparation, the cells are preferably present in the composition in an amount that the total volume of the composition administered is 0.5 ml to 5.0 ml, typically 1.0-2.0 ml. The amount administered will vary depending on various factors including, but not limited to, the specific polypeptides chosen, the weight, physical condition and age of the animal, and the route of administration. Thus, the absolute weight of the polypeptide included in a given unit dosage form can vary widely, and depends upon factors such as the species, age, weight and physical condition of the animal, as well as the method of administration. Such factors can be determined by one of skill in the art. Other examples of dosages suitable for the invention are disclosed in Emery et al., (U.S. Pat. No. 6,027,736).

The formulations may be conveniently presented in unit dosage form and may be prepared by methods well known in the art of pharmacy. All methods of preparing a composition including a pharmaceutically acceptable carrier include the step of bringing the active compound (e.g., a polypeptide or whole cell of the present invention) into association with a carrier that constitutes one or more accessory ingredients. In general, the formulations are prepared by uniformly and intimately bringing the active compound into association with a liquid carrier, a finely divided solid carrier, or both, and then, if necessary, shaping the product into the desired formulations.

A composition including a pharmaceutically acceptable carrier can also include an adjuvant. An "adjuvant" refers to an agent that can act in a nonspecific manner to enhance an immune response to a particular antigen, thus potentially reducing the quantity of antigen necessary in any given immunizing composition, and/or the frequency of injection necessary in order to generate an adequate immune response to the antigen of interest. Adjuvants may include, for example, IL-1, IL-2, emulsifiers, muramyl dipeptides, dimethyldiocradecylammonium bromide (DDA), pyridine, aluminum hydroxide, oils, saponins, alpha-tocopherol, polysaccharides, emulsified paraffins (including, for instance, those available from under the tradename EMULSIGEN from MVP Laboratories, Ralston, Nebr.), ISA-70, RIBI and other substances known in the art.

In another embodiment, a composition of the invention including a pharmaceutically acceptable carrier can include a biological response modifier, such as, for example, IL-2, IL-4 and/or IL-6, TNF, IFN-alpha, IFN-gamma, and other cytokines that effect immune cells. An immunizing composition can also include other components known to the art such as an antibiotic, a preservative, an anti-oxidant, or a chelating agent.

Methods of Making

The polypeptides and whole cells of the present invention are obtainable from a member of the family Enterobacteriaceae, for instance, a member of the tribe Escherichieae or Salmonelleae. Preferred examples of members of the tribe Escherichieae are *E. coli* and *Salmonella* spp. A *Salmonella* spp. can be a member of serogroup A, B, $C_1$, $C_2$, $C_3$, $D_1$, $D_2$, $D_3$, $E_1$, $E_2$, $E_3$, $E_4$, $G_1$, $G_2$, H, I, J, K, L, M, N, O, P, Q, R, S, T, U, V, W, X, Y, Z, 51, 52, 53, 54, 55, 56, 57, 58, 59, or 60. Preferred examples of *Salmonella* spp. are *S. cholerasuis*, *S.*

*typhi*, or one of the *S. enterica* serovars, e.g., Bredeney, Dublin, Agona, Blockley, Enteriditis, Typhimurium, Hadar, Heidelberg, Montevideo, Muenster, Newport, or Senftenberg, most preferably, *S. enterica* serovar Newport, *S. enterica* serovar Enteritidis, *S. enterica* serovar Typhimurium, and *S. enterica* serovar Dublin. Microbes useful for obtaining polypeptides of the present invention and making whole cell preparations are commercially available from a depository such as American Type Culture Collection (ATCC). In addition, such microbes are readily obtainable by techniques routine and known to the art. The microbes may be derived from an infected animal as a field isolate, and used to obtain polypeptides and/or whole cell prearations of the present invention, or stored for future use, for example, in a frozen repository at −20° C. to −95° C., or −40° C. to −50° C., in bacteriological media containing 20% glycerol, and other like media.

When a polypeptide of the present invention is to be obtained from a microbe, the microbe can be incubated under low metal conditions. As used herein, the phrase "low metal conditions" refers to an environment, typically bacteriological media, that contains amounts of a free metal that cause a microbe to express metal regulated polypeptides. As used herein, the phrase "high metal conditions" refers to an environment that contains amounts of a free metal that cause a microbe to either not express one or more of the metal regulated polypeptides described herein, or to decrease expression of such a polypeptide. Metals are those present in the periodic table under Groups 1 through 17 (IUPAC notation; also referred to as Groups I-A, II-A, III-B, IV-B, V-B, VI-B, VII-B, VIII, I-B, II-B, III-A, IV-A, V-A, VI-A, and VII-A, respectively, under CAS notation). Preferably, metals are those in Groups 2 through 12, more preferably, Groups 3-12. Even more preferably, the metal is iron, zinc, copper, magnesium, nickel, cobalt, manganese, molybdenum, or selenium, most preferably, iron.

Low metal conditions are generally the result of the addition of a metal chelating compound to a bacteriological medium. High metal conditions are generally present when a chelator is not present in the medium, a metal is added to the medium, or the combination thereof. Examples of metal chelators include natural and synthetic compounds. Examples of natural compounds include plant phenolic compounds, such as flavenoids. Examples of flavenoids include the copper chelators catechin and naringenin, and the iron chelators myricetin and quercetin. Examples of synthetic copper chelators include, for instance, tetrathiomolybdate, and examples of synthetic zinc chelators include, for instance, N,N,N',N'-Tetrakis(2-pyridylmethyl)-ethylene diamine. Examples of synthetic iron chelators include 2,2'-dipyridyl (also referred to in the art as $\alpha,\alpha'$-bipyridyl), 8-hydroxyquinoline, ethylenediamine-di-O-hydroxyphenylacetic acid (EDDHA), desferrioxamine methanesulphonate (desferol), transferrin, lactoferrin, ovotransferrin, biological siderophores, such as, the catecholates and hydroxamates, and citrate. Preferably, 2,2'-dipyridyl is used for the chelation of iron. Typically, 2,2'-dipyridyl is added to the media at a concentration of at least 0.0025 micrograms/milliliter (μg/ml), at least 0.025 μg/ml, or at least 0.25 μg/ml. High levels of 2,2'-dipyridyl can be 10 μg/ml, 20 μg/ml, or 30 μg/ml.

It is expected that a *Salmonella* spp. or *E. coli* with a mutation in a fur gene will result in the constitutive expression of many, if not all, of the metal regulated polypeptides of the present invention. The production of a fur mutation in a *Salmonella* spp. or *E. coli* can be produced using routine methods including, for instance, transposon, chemical, or site-directed mutagenesis useful for generating gene knock-out mutations in gram negative bacteria.

The medium used to incubate the microbe and the volume of media used to incubate the microbe can vary. When a microbe is being evaluated for the ability to produce one or more of the polypeptides described herein, the microbe can be grown in a suitable volume, for instance, 10 milliliters to 1 liter of medium. When a microbe is being grown to obtain polypeptides for use in, for instance, administration to animals, the microbe may be grown in a fermentor to allow the isolation of larger amounts of polypeptides. Methods for growing microbes in a fermentor are routine and known to the art. The conditions used for growing a microbe preferably include a metal chelator, more preferably an iron chelator, for instance 2,2'-dipyridyl, a pH of between 6.5 and 7.5, preferably between 6.9 and 7.1, and a temperature of 37° C.

In some aspects of the invention, a microbe may be harvested after growth. Harvesting includes concentrating the microbe into a smaller volume and suspending in a media different than the growth media. Methods for concentrating a microbe are routine and known to the art, and include, for example, filtration or centrifugation. Typically, the concentrated microbe is suspended in decreasing amounts of buffer. Preferably, the final buffer includes a metal chelator, preferably, ethylenediaminetetraacetic acid (EDTA). An example of a buffer that can be used contains Tris-base (7.3 grams/liter) and EDTA (0.9 grams/liter), at a pH of 8.5. Optionally, the final buffer also minimizes proteolytic degradation. This can be accomplished by having the final buffer at a pH of greater than 8.0, preferably, at least 8.5, and/or including one or more proteinase inhibitors (e.g., phenylmethanesulfonyl fluoride). Optionally and preferably, the concentrated microbe is frozen at −20° C. or below until disrupted.

When the microbe is to be used as a whole cell preparation, the harvested cells may be processed using routine and known methods to inactivate the cells. Alternatively, when a microbe is to be used to prepare polypeptides of the present invention, the microbe may be disrupted using chemical, physical, or mechanical methods routine and known to the art, including, for example, french press, sonication, or homoginization. Preferably, homoginization is used. As used herein, "disruption" refers to the breaking up of the cell. Disruption of a microbe can be measured by methods that are routine and known to the art, including, for instance, changes in optical density. Typically, a microbe is subjected to disruption until the percent transmittance is increased by 20% when a 1:100 dilution is measured. The temperature during disruption is typically kept low, preferably at 4° C., to further minimize proteolytic degradation.

The disrupted microbe is solubilized in a detergent, for instance, an anionic, zwitterionic, nonionic, or cationic detergent. Preferably, the detergent is sarcosine, more preferably, sodium lauroyl sarcosinate. As used herein, the term "solubilize" refers to dissolving cellular materials (e.g., polypeptides, nucleic acids, carbohydrates) into the aqueous phase of the buffer in which the microbe was disrupted, and the formation of aggregates of insoluble cellular materials. The conditions for solubilization preferably result in the aggregation of polypeptides of the present invention into insoluble aggregates that are large enough to allow easy isolation by, for instance, centrifugation.

Preferably, the sarcosine is added such that the final ratio of sarcosine to gram weight of disrupted microbe is between 1.0 gram sarcosine per 4.5 grams pellet mass and 6.0 grams sarcosine per 4.5 grams pellet mass, preferably, 4.5 gram sarcosine per 4.5 grams pellet mass. The solubilization of the microbe may be measured by methods that are routine and known to the art, including, for instance, changes in optical density. Typically, the solubilization is allowed to occur for at least 24 hours, more preferably, at least 48 hours, most preferably, at least 60 hours. The temperature during disruption is typically kept low, preferably at 4° C.

The insoluble aggregates that include one or more of the polypeptides of the present invention may be isolated by methods that are routine and known to the art. Preferably, the insoluble aggregates are isolated by centrifugation. Typically, centrifugation of outer membrane polypeptides that are insoluble in detergents requires centrifugal forces of at least 50,000×g, typically 100,000×g. The use of such centrifugal forces requires the use of ultracentrifuges, and scale-up to process large volumes of sample is often difficult and not economical with these types of centrifuges. The methods described herein provide for the production of insoluble aggregates large enough to allow the use of significantly lower centrifugal forces (for instance, 46,000×g). Methods for processing large volumes at these lower centrifugal forces are available and known to the art. Thus, the insoluble aggregates can be isolated at a significantly lower cost.

Optionally and preferably, the sarcosine is removed from the isolated polypeptides. Methods for removing sarcosine from the isolated polypeptides are known to the art, and include, for instance, diafiltration, precipitation, hydrophobic chromatography, ion-exchange chromatography, or affinity chromatography, and ultra filtration and washing the polypeptides in alcohol by diafiltration. After isolation, the polypeptides suspended in buffer and stored at low temperature, for instance, −20° C. or below.

Polypeptides of the present invention may also be isolated from microbes using methods that are known to the art. The isolation of the polypeptides may be accomplished as described in, for instance, Emery et al., (U.S. Pat. No. 5,830, 479) and Emery et al., (U.S. Patent Application U.S. 20030036639 A1).

In those aspects of the present invention where a whole cell preparation is to be made, after growth a microbe can be killed with the addition of an agent such as glutaraldehyde, formalin, or formaldehyde, at a concentration sufficient to inactivate the cells in the culture. For instance, formalin can be added at a concentration of 3% (vol:vol). After a period of time sufficient to inactivate the cells, the cells can be harvested by, for instance, diafiltration and/or centrifugation, and washed.

Methods of Use

An aspect of the present invention is further directed to methods of using the compositions of the present invention. The methods include administering to an animal an effective amount of a composition of the present invention. The animal can be, for instance, avian (including, for instance, chickens or turkeys), bovine (including, for instance, cattle), caprine (including, for instance, goats), ovine (including, for instance, sheep), porcine (including, for instance, swine), bison (including, for instance, buffalo), a companion animal (including, for instance, horses), members of the family Cervidae (including, for instance, deer, elk, moose, caribou and reindeer), or human.

In some aspects, the methods may further include additional administrations (e.g., one or more booster administrations) of the composition to the animal to enhance or stimulate a secondary immune response. A booster can be administered at a time after the first administration, for instance, 1 to 8 weeks, preferably 2 to 4 weeks, after the first administration of the composition. Subsequent boosters can be administered one, two, three, four, or more times annually.

Without intending to be limited by theory, it is expected that in some aspects of the present invention annual boosters will not be necessary, as an animal will be challenged in the field by exposure to microbes expressing polypeptides present in the compositions having epitopes that are identical to or structurally related to epitopes present on polypeptides of the composition administered to the animal.

In one aspect, the invention is directed to methods for inducing the production of antibody in an animal or by recombinant techniques. The antibody produced includes antibody that specifically binds at least one polypeptide present in the composition. In this aspect of the invention, an "effective amount" is an amount effective to result in the production of antibody in the animal. Methods for determining whether an animal has produced antibodies that specifically bind polypeptides present in a composition of the present invention can be determined as described herein.

The method may be used to produce antibody that specifically binds polypeptides expressed by a microbe other than the microbe from which the polypeptides of the composition were isolated. As used herein, an antibody that can "specifically bind" a polypeptide is an antibody that interacts with the epitope of the antigen that induced the synthesis of the antibody, or interacts with a structurally related epitope. At least some of the polypeptides present in the compositions of the present invention typically include epitopes that are conserved in the polypeptides of different species and different genera of microbes (see Example 26). Accordingly, antibody produced using a composition derived from one microbe is expected to bind to polypeptides expressed by other microbes and provide broad spectrum protection against gram negative organisms. Examples of gram negative microbes to which the antibody specifically binds are enteropathogens, for instance, members of the family Enterobacteriaceae.

In another aspect, the present invention is directed to methods for treating one or more symptoms of certain conditions in animals that may be caused by, or associated with, a microbe. Such conditions include, for instance, gram negative microbial infections. Examples of conditions caused by microbial infections include mastitis, intestinal colonization by a microbe, metritis, strangles, intrauterine infections, odema disease, enteritis, chronic reproductive infections, laminitis, mastitis, and acute or chronic chlamydiosis, colibacillosis, ehrlichiosis, leptospirosis, pasteurellosis, pseudotuberculosis, and salmonellosis. Examples of conditions that may be caused by microbial infections include performance characteristics such as decreased milk production, high somatic cell counts, poor milk quality, and weight loss. Treatment of these conditions can be prophylactic or, alternatively, can be initiated after the development of a condition described herein. Treatment that is prophylactic, for instance, initiated before a subject manifests symptoms of a condition caused by a microbe, is referred to herein as treatment of a subject that is "at risk" of developing the condition. Typically, an animal "at risk" of developing a condition is an animal present in an area where the condition has been diagnosed and/or is likely to be exposed to a microbe causing the condition. Accordingly, administration of a composition can be performed before, during, or after the occurrence of the conditions described herein. Treatment initiated after the development of a condition may result in decreasing the severity of the symptoms of one of the conditions, or completely removing the symptoms. In this aspect of the invention, an "effective amount" is an amount effective to prevent the manifestation of symptoms of a disease, decrease the severity of the symptoms of a disease, and/or completely remove the symptoms. The potency of a composition of the present invention can be tested according to established standard methods detailed at Title 9 of the Code of Federal Regulations, section 113. For instance, 9 CFR §113.120(c) and 9 CFR §113.123(c) describe standard methods for determining the potency of the composition against a standard reference bacterin of *Salmonella enterica* serovar Typhimurium and *Salmonella enterica* serovar Dublin, respectively. Methods for determining whether an animal has the conditions disclosed herein and symptoms associated with the conditions are routine and known to the art (see, for instance, Zhang et al., Infect. Immun., 71:1-12 (2003)).

In one aspect the invention is also directed to treating a gram negative microbial infection in an animal in an animal. The method includes administering an effective amount of a composition of the present invention to an animal having or at risk of having a gram negative infection, and determining whether at least one symptom of the gram negative infection is reduced. The successful treatment of a gram negative microbial infection in an animal is disclosed in Examples 3-9. Working Examples 3-5, 6, and 9 demonstrate the protection against disease by caused by *Salmonella enterica* serovar Newport and by *Salmonella enterica* serovar Dublin in mouse models by administering a composition of the present invention. Working Examples 7-8 demonstrate the protection against disease by caused by *E. coli* O157:H7 in a mouse model by administering a composition of the present invention. These mouse models are a commonly accepted model for the study of human disease caused by these microbes.

The present invention is also directed to decreasing colonization of the intestinal tract or reproductive tract of an animal by a gram negative microbe. The method includes administering an effective amount of a composition of the present invention to an animal colonized by, or at risk of being colonized by a gram negative microbe. In this aspect of the invention, an "effective amount" is an amount effective to decrease colonization of the animal by the microbe. Colonization of an animal's intestinal tract by a microbe can be determined by measuring the presence of the microbe in the animal's feces. The successful decrease of colonization by *Salmonella* and by *E. coli* is disclosed in Examples 6, 7-8, 10-15, and 16-19. Working Examples 6 and 10-15 demonstrate the decreased colonization by *Salmonella* in mice and in cattle. Working Examples 7-8 and 16-19 demonstrate the decreased colonization by *E. coli* O157:H7 in mice and in cattle. Cattle are considered to be one of the important natural reservoirs of *E. coli* O157:H7 that contaminate food and cause human disease. Methods for evaluating the colonization of an animal's reproductive tract by a microbe are routine and known to the art. It is expected that decreasing the colonization of an animal by a microbe will reduce transmission of the microbe to humans.

A composition of the invention can be used to provide for active or passive immunization against bacterial infection. Generally, the composition can be administered to an animal to provide active immunization. However, the composition can also be used to induce production of immune products, such as antibodies, which can be collected from the producing animal and administered to another animal to provide passive immunity. Immune components, such as antibodies, can be collected to prepare antibody compositions from serum, plasma, blood, colostrum, etc. for passive immunization therapies. Antibody compositions comprising monoclonal antibodies and/or anti-idiotypes can also be prepared using known methods. Passive antibody compositions and fragments thereof, e.g., scFv, Fab, $F(ab')_2$ or Fv or other modified forms thereof, may be administered to a recipient in the form of serum, plasma, blood, colostrum, and the like. However, the antibodies may also be isolated from serum, plasma, blood, colostrum, and the like, using known methods for later use in a concentrated or reconstituted form such as, for instance, lavage solutions, impregnated dressings and/or topical agents and the like. Passive immunizing preparations may be particularly advantageous for treatment of acute systemic illness, or passive immunization of young animals that failed to receive adequate levels of passive immunity through maternal colostrum. Antibodies useful for passive immunization may also be useful to conjugate to various drugs or antibiotics that could be directly targeted to bacteria expressing these proteins during a systemic or localized infection.

Another aspect of the present invention provides methods for detecting antibody that specifically binds polypeptides of the present invention. These methods are useful in, for instance, detecting whether an animal has antibody that specifically bind polypeptides of the present invention, and diagnosing whether an animal may have a condition caused by a microbe expressing polypeptides described herein, or expressing polypeptides that share epitopes with the polypeptides described herein. Such diagnostic systems may be in kit form. The methods include contacting an antibody with a preparation that includes polypeptides of the present invention to result in a mixture. The antibody may be present in a biological sample, for instance, blood, milk, or colostrum. The method further includes incubating the mixture under conditions to allow the antibody to specifically bind the polypeptide to form a polypeptide:antibody complex. As used herein, the term "polypeptide:antibody complex" refers to the complex that results when an antibody specifically binds to a polypeptide. The preparation that includes the polypeptides of the present invention may also include reagents, for instance a buffer, that provide conditions appropriate for the formation of the polypeptide:antibody complex. The polypeptide:antibody complex is then detected. The detection of antibodies is known in the art and can include, for instance, immunofluorescence and peroxidase. The methods for detecting the presence of antibodies that specifically bind to polypeptides of the present invention can be used in various formats that have been used to detect antibody, including radioimmunoassay and enzyme-linked immunosorbent assay.

The present invention also provides a kit for detecting antibody that specifically binds polypeptides of the present invention. The kit includes at least one of the polypeptides of the present invention, or a number of polypeptides that is an integer greater than 1 (e.g., at least 2, at least 3, etc.), in a suitable packaging material in an amount sufficient for at least one assay. Optionally, other reagents such as buffers and solutions needed to practice the invention are also included. Instructions for use of the packaged polypeptides are also typically included. As used herein, the phrase "packaging material" refers to one or more physical structures used to house the contents of the kit. The packaging material is constructed by well known methods, generally to provide a sterile, contaminant-free environment. The packaging material has a label which indicates that the polypeptides can be used for detecting antibody that specifically binds polypeptides of the present invention. In addition, the packaging material contains instructions indicating how the materials within the kit are employed to detect the antibody. As used herein, the term "package" refers to a solid matrix or material such as glass, plastic, paper, foil, and the like, capable of holding within fixed limits the polypeptides. Thus, for example, a package can be a microtiter plate well to which microgram quantities of polypeptides have been affixed. "Instructions for use" typically include a tangible expression describing the reagent concentration or at least one assay method parameter, such as the relative amounts of reagent and sample to be admixed, maintenance time periods for reagent/sample admixtures, temperature, buffer conditions, and the like.

The present invention is illustrated by the following examples. It is to be understood that the particular examples, materials, amounts, and procedures are to be interpreted broadly in accordance with the scope and spirit of the invention as set forth herein.

Example 1

Production and Isolation of Metal Regulated Proteins

Gram negative enteric bacteria belonging to the families Enterobacteriaceae and Vibrionaceae as well as other gram negative bacteria can be grown under controlled fermentation conditions so as to express proteins, including proteins associated with the outer membrane. The bacteria can be harvested and the proteins can then be isolated and used as immunogens in a composition described in detail in the following example.

The immunizing compositions used in the following examples were prepared using the proteins derived from two enteric pathogens; a multi-drug resistant isolate of *Salmonella enterica* serovar Newport and an *Escherichia coli* O157:H7 isolate, both originating from a bovine species.

*Salmonella enterica* serovar Newport was isolated from fecal cultures of cows at a commercial dairy showing clinical signs of salmonellosis. This isolate was also recovered from the owners of the dairy who became sick after ingesting raw milk. Isolation was accomplished using Brilliant Green Sulfa broth and Brilliant Green Selective agar plates. The isolate was serotyped by the Centers for Veterinary Biologics Laboratory (Ames, Iowa) and by the Minnesota Poultry Testing Laboratory, Minnesota Board of Animal Health (Willmar, Minn.). The *Escherichia coli* isolate O157:H7 originated from steers isolated from a commercial feed lot. As detected by PCR, the strin was found to be serotype O157:H7, and possessed the eaeA and hlyA genes but not the stx1 and stx2 genes.

Master seed stocks of the *Salmonella* Newport and *E. coli* O157:H7 isolates were prepared by inoculating each of the isolates into 200 ml of Tryptic Soy Broth (Difco Laboratories, Detroit, Mich.) containing 50 micrograms per milliliter (μg/ml) of 2,2-dipyridyl (Sigma-Aldrich St. Louis, Mo.). The cultures were grown while stirring at 200 rpm for 6 hours at 37° C. The bacteria were collected by centrifugation at 10,000×g. The bacterial pellets from each isolate was resuspended into 100 ml physiological saline (0.85%) containing 20% glycerol, and sterilely dispensed into 2 ml cryogenic vials (1 ml per vial) and stored at −90° C. Each isolate was given an identification number designating it as a master seed. The master seed number for *Salmonella* Newport was MS020508 (ATCC Accession No. PTA-9496) while the O157:H7 isolate was designated as BEcO157(stx-). Each master seed was expanded into a working seed that was then used for the production of metal regulated proteins. A large-scale production process was developed involving fermentation, bacterial harvest, disruption, solubilization, concentration, diafiltration, and isolation of final product.

Fermentation

A cryogenic vial of the working seed (1 ml at $10^9$ CFU/ml) was used to inoculate 500 ml of 37° C. tryptic soy broth (TSB) without dextrose (Difco) containing 50 micrograms 2,2-dipyridyl (Sigma), 2.7 grams BITEK yeast extract (Difco) and glycerol (3% vol/vol). The culture was incubated at 37° C. for 12 hours while stirring at 200 rpm, and then added to 2 liters of the above media. This second culture was allowed to grow for an additional 4 hours at 37° C. This culture was used to inoculate a 20-liter VIRTIS bench-top fermentor, (Virtis, Gardiner, N.Y.) charged with 13 liters of the above-described media. The pH was held constant between 6.9 and 7.1 by automatic titration with 30% NaOH and 10% HCL. The stirring speed was adjusted to 400 revolutions per minute (rev/minute), and the culture aerated with 11 liters air/minute at 37° C. Foaming was controlled automatically by the addition of 11 ml defoamer (MAZU DF 204 Chem/Serv, Minneapolis, Minn.). The culture was allowed to grow continuously at these conditions for 4 hours at which time was sterilely pumped into a 150-liter fermentor (W. B. Moore, Easton, Pa.). The fermentor was charged with 115 liters TSB without dextrose (3,750.0 grams), BITEK yeast extract (625 grams), glycerol (3750 ml), 2,2-dypyrdyl (3.13 grams) and qtr MAZU DF 204 defoamer (100 ml). The parameters of the fermentation were as follows: dissolved oxygen (DO) was maintained at 30%+/−10% by increasing agitation to 220 rev/minute sparged with 60 liters of air/minute and 10 pounds per square inch (psi) back pressure. The pH was held constant between 6.9 and 7.1 by automatic titration with 30% NaOH and 10% HCL. The temperature was maintained at 37° C. At hour 4.5 (optical density 8-9 at 540 nanometers), the culture was supplemented with additional nutrients by feeding 7 liters of media containing 1,875 grams TSB without dextrose, 313 grams yeast extract 3.13 grams 2,2-dipyridyl and 1,875 ml of glycerol. The rate of feed was adjusted to 29 ml/minute while increasing agitation to 675 rpm. At the end of the feed (hour 8.5) the fermentation was allowed to continue for an additional three hours at which point the fermentation was terminated by lowering the temperature of the fermentor to 10° C. (optical density 35-40 at 540 nanometers at a 1:100 dilution). The culture was sterilely transferred to a 200-liter tank (LEE Process Systems and Equipment model 2000LDBT) in preparation for harvest.

Harvest

The bacterial fermentation was concentrated and washed using a PALL FILTRON TANGENTIAL FLOW MAXISET-25 (Pall Filtron Corporation, Northboro, Mass.) equipped with two 30 $ft^2$ Alpha 300-K open channel filters, catalog No. AS300C5, (Pall Filtron) connected to a Waukesha Model U-60 feed pump (Waukesha Chemy-Burrell, Delevan, Wis.) The original culture volume of 125 liters was reduced to 25 liters (2.5 liters/minute) using a filter inlet pressure of 15 psi and a retentate pressure of 0 psi. The bacterial retentate was adjusted back up to 50 liters using physiological saline (0.85%) and then concentrated again to 15 liters to help remove any contaminating exogenous proteins, etc. The retentate (15 liters) was adjusted to 35 liters using sterile Osmotic Shock Buffer (OMS) containing 7.26 grams/liter Tris-base and 0.93 grams/liter EDTA adjusted to a pH of 8.5. The EDTA in the OMS serves to remove much of LPS from the cell wall, while the elevated pH prevents much of the proteolytic degradation after freezing and disruption. Protease inhibitors may be used instead of, or in addition to, an elevated pH. The retentate was mixed thoroughly while in the 200-liter tank using a bottom mount magnetically driven mixer. The retentate was sterilely dispensed (3.5 liters) into sterile 4 liter NALGENE containers No. 2122 and placed into a −20° C. freezer for storage. Freezing the bacterial pellet serves to weaken the cell wall structure making downstream disruption more efficient. The pellet mass was calculated by centrifuging 30 ml samples of the fermented culture and final harvest. Briefly, pre-weighted 50 ml NALGENE conical tubes were centrifuged at 39,000×g for 90 minutes in a BECKMAN J2-21 centrifuge using a JA-21 rotor (Beckman Instruments, Palo Alto Calif.). At the end of the run, the supernate was poured off and the tubes were weighed again. The pellet mass was calculated for each stage. The fermentation process yielded a wet pellet mass of 9.0 kilograms.

Disruption (Homogenization)

Twenty kilograms of frozen bacterial cell slurry in OMS were thawed at 4° C. (20 kg of pellet mass). The liquid culture suspension from each container was aseptically aspirated into a steam in place 250 liter jacketed process tank (Lee, Model 259LU) with a top mounted mixer (Eastern, Model TME-1/2, EMI Incorporated, Clinton, Conn.) containing 222 liters OMS pH 8.5 containing 0.1 grams thimerosal/liter as preservative. The volume of OMS was determined by dividing the pellet mass (in grams) by 900 and then multiplying the result by 10 to get the homogenizing volume in liters (gram pellet mass/900×10=liters homogenizing volume). The bulk bacterial suspension was chilled to 4° C. with continuous mixing for 18 hours at 200 rpm at which time it was disrupted by homogenization. Briefly, the 250 liter tank containing the bacterial suspension was connected to a model 12.51 H Rannie Homogenizer, (APV Systems, Rosemont, Ill.). A second 250 liter jacketed process tank (empty) was connected to the homogenizer such that the fluid in the process tank could be passed through the homogenizer, into the empty tank and back again, allowing for multiple homogenizing passes while still maintaining a closed system. The temperature during homogenization was kept at 4° C. At the start of each pass, fluid was circulated at 70 psi via a Waukesha model 10DO pump (Waukesha) through the homogenizer (160 gallons/hour) and back to the tank of origin, while the homogenizer pressure was adjusted to 13,500 psi. Prior to the first pass, two pre-homogenizing samples were withdrawn from the homogenizer to establish a baseline for determining the degree of disruption and monitoring of pH. The degree of disruption was monitored by transmittance (% T at 540 nm at 1:100 dilution) compared to the non-homogenized sample. The number of passes through the homogenizer was standardized for different organisms based on the integrity of the cell wall and variation in the degree of disruption, which had a direct correlation in the efficiency of solubilization and quality of end product. For example, the disruption of *Salmonella* passed three times through the homogenizer gave a final percent transmittance between 78-83% T at a 1:100 dilution. *E. coli* having the same pellet mass and starting OD gave a % T of 86-91% (at a 1:100 dilution) after the third pass. It has been observed that bacteria differ in their cell wall integrity and vary in their capacity of disruption under identical condition. This variation can effect the degree and efficiency of solubilization and recovery of metal regulated proteins. In general, cells were passed through the homogenizer until the transmittance did not increase after an additional pass.

After homogenization, Sodium Lauroyl Sarcosinate (HAMPOSYL L-30, Chem/Serv) was aseptically added to the homogenized bacterial suspension for solubilization. The amount of sarcosine (30%) added equaled 0.0664 times the solubilizing volume, in liters, (1.0 gram sarcosine/4.5 grams pellet mass). The tank was removed from the homogenizer and put onto a chiller loop at 4° C. and mixed at 240 rpm for 60-70 hours. This time period was important for complete solubilization. It was discovered that increasing the solubilization time in OMS at an elevated pH (8.0-8.5) that metal regulated proteins aggregated together forming large insoluble aggregates that were easily removed by centrifugation. The optimal OD after solubilization was usually between 25-30% T at 540 nm.

Protein Harvest

The aggregated metal regulated proteins within the solubilized process fluid were collected by centrifugation using T-1 SHARPLES, (Alfa Laval Seperations, Warminster, Pa.). Briefly, the tank of solubilized homogenate was fed into six SHARPLES with a feed rate of 250 ml/minute at 17 psi at a centrifugal force of 46,000×g. The effluent was collected into a second 250 liter jacketed process tank through a closed sterile loop allowing for multiple passes through the centrifuges while maintaining a closed system. The temperature during centrifugation was kept at 4° C. The solubilized homogenate was passed 8 times across the centrifuges. Fifty percent of the protein was collected after the second pass, at which point the solubilized fluid was concentrated to ⅓ of its original volume. This decrease in volume shortened the process time for the next 6 passes. Briefly, the solubilized homogenate tank was aseptically disconnected from the centrifuges and connected to a MILLIPORE PELLICON TANGENTIAL FLOW FILTER assembly (Millipore Corporation, Bedford, Mass.), equipped with a 25 ft$^2$ screen-channel series Alpha 10K Centrasette filter (Pall Filtron) connected to a Waukesha Model U30 feed pump for concentration. After concentration, centrifugation was continued until the process was completed. Protein was collected after each pass. The protein was collected, resuspended and dispensed in 50 liters Tris-buffer pH 8.5 containing 0.3% formalin (Sigma) as preservative.

Diafiltration

The protein suspension was washed by diafiltration at 4° C. to remove any contaminating sarcosine that may have been bound to the protein. Briefly, the 50 liters of protein was sterilely aspirated into a 200 liter process tank containing 50 liters sterile Tris-buffer, pH 8.5, equipped with a bottom mount Dayton mixer, Model 2Z846 (Dayton Electric, Chicago, Ill.) rotating at 125 rev/minute. The process tank was sterilely connected to a MILLIPORE PELLICON TANGENTIAL FLOW FILTER assembly (Millipore Corporation), equipped with a 25 ft$^2$ screen-channel series Alpha 10K Centrasette filter (Pall Filtron) connected to a Waukesha Model U30 feed pump. The 100 liter protein solution was concentrated by filtration to a target volume of 5.45 times the protein pellet mass, at which point Tris-buffer, pH 7.4, containing 5% isopropyl alcohol was slowly added to the concentrate from a second process tank. Isopropyl alcohol is believed to cause a slight unfolding of the protein structure allowing for the removal of bound sarcosine without compromising the immunogenicity of the protein. Diafiltration continued until the pH stabilized to 7.4 at which point 50 liters Tris-buffer pH 7.4 was slowly added by diafiltration to remove residual alcohol. The protein suspension was then concentrated to approximately 25 liters. The protein concentrate was aseptically dispensed (3.5 liters) into sterile 4 liter NALGENE containers and placed into a −20° C. freezer for storage.

This process produces a composition containing metal regulated proteins with a decrease in the amount of LPS and very little to no sarcosine residue. The protein was examined by SDS-PAGE for purity and banding profile, and also examined for bacterial contamination, residual sarcosine and LPS. The banding profile of the finished product showed consistent patterns as examined by electrophoresis. The composition was tested for sarcosine by the use of a modified agar gel diffusion test in which sheep red blood cells (5%) were incorporated into an agar base (1.5%). Wells were cut into the agar and samples of the finished product along with control samples of known concentrations of sarcosine at 0.05, 0.1, 0.2, 0.3, 0.4, 0.5 1.0 and 2.0% were placed into the wells. The gel was incubated at 25° C. for 24 hours and the degree of hemolysis was determined compared to the controls. The process removes the level of detectable sarcosine below 0.05%, which at this concentration showed minimal hemolysis in control samples. The concentration of LPS is examined by a *Limulus* amebocyte lysate (LAL) test available under the tradename PYROTELL (Associates of Cape Cod, Inc., East Falmouth, Mass.).

The compositions used in the following examples were prepared and harvested as described in Example 1. The efficacy of each composition was evaluated in separate experiments based on the route of challenge. Data was collected on the following parameters; 1) the potency of the immunizing compositions, which was evaluated against a live virulent challenge given intraperitoneally to measure systemic protection, 2) the efficacy of each composition, which was evaluated after administering the challenge dose orally to evaluate the effect on colonization or fecal shedding of the challenge organism, and 3) examination of the injection sites for any adverse tissue reaction.

Example 2

Preparation of the Immunizing Compositions Derived from *S. enterica* Serovar Newport and *E. coli* O157:H7

The proteins made from *S. enterica* serovar Newport and *E. coli* as described in Example 1 were used to prepare two compositions for administration to animals. The composition prepared from *S. enterica* serovar Newport contained the proteins described in Table 2, and the composition prepared from *E. coli* O157:H7 contained the proteins described in Table 6. A stock vaccine was prepared from each composition by emulsifying the aqueous protein suspension (500 µg total protein/ml) into the commercial adjuvant, EMULSIGEN, (MVP Laboratories, Ralston, Nebr.) using an IKA ULTRA-TURRAX T-50 homogenizing vessel (IKA, Cincinnati, Ohio). The stock vaccine was used at two different injectable volumes depending on the target animal it would be used in. A mouse dose was administered to give a final dose of 50 µg total protein in a 0.1 ml injectable volume with an adjuvant concentration of 22.5% vol/vol. The bovine dose was given using a two milliliter injectable volume to provide a dose of 1000 µg total protein. A placebo was prepared by replacing the antigen with physiological saline in the above formulation and emulsifying the suspension into EMULSIGEN to give an adjuvant concentration of 22.5%.

A standard reference bacterin Of *Salmonella enterica* serovar Dublin was obtained from the Center of Veterinary Biologics-Laboratory (United States Department of Agriculture, Ames, Iowa, strain APHIS NVSL #82, *Salmonella* Dublin, Lot Number IRP DSC #5) for use as a control reference in accordance with the standardized mouse model described in 9 CFR 113.123. This was provided as a whole cell bacterin prepared in AlOH.

Example 3

Mouse Vaccination and Challenge Study

Systemic Evaluation

The efficacy of the *S. enterica* serovar Newport vaccine was carried out against a live virulent challenge in mice. One hundred twenty five (N=125) female CF-1 mice obtained from Harlan Breeding Laboratories (Indianapolis, Ind.) weighing 16-22 grams were equally distributed into five groups (25 mice/group). Mice were housed in polycarbonate mouse cages (Ancore Corporation, Bellmore, N.Y.). Two cages were used for each treatment group to minimize the number of mice for each cage. Groups were designated as 1-5. Food and water were supplied ad libitum to all mice.

The potency of the vaccine was tested at four different concentrations; non-diluted stock vaccine (Group 1, 50 µg/0.1 ml), 1:10 (volume diluent: volume protein solution) (Group 2, 5.0 µg/0.1 ml), 1:100 (Group 4, 0.5 µg/0.1 ml), 1:1000 (Group 4, 0.05 µg/0.1 ml) and a Placebo (non-vaccinated/challenged control group) (Group 5). EMULSIGEN as used as the diluent for diluting the stock vaccine so as to maintain the concentration of adjuvant at a 22.5% for each treatment group. Mice were vaccinated intraperitoneally two times at 14 day intervals. The volume administered was 0.1 ml/mouse.

Example 4

Preparation of Challenge Organism

The *S. enterica* serovar Newport as described above was used for challenge. Briefly, the isolate from a frozen stock was streaked onto a blood agar plate and incubated at 37° C. for 18 hours. A single colony was subcultured into 50 ml Tryptic Soy Broth (Difco) containing 25 µg/ml 2,2' dipyridyl. The culture was incubated at 37° C. for 6 hours while rotating at 200 rpm, at which point was centrifuged at 10,000×g for 10 minutes at 4° C. to pellet the bacteria. The bacterial pellet was washed twice by centrifugation in physiological saline at 4° C. The final pellet was resuspended in 25 ml of physiological saline and used for challenge. Just prior to challenge, 1 ml of the above bacterial suspension was serially diluted ten fold to enumerate the number of CFU/mouse dose.

Example 5

Challenge

Fourteen days after the 2nd vaccination, mice in groups 1-5 were intraperitoneally challenged with 0.2 ml of *S. enterica* serovar Newport at $7.6 \times 10^8$ colony forming units (CFU) prepared as described at example 4. Mortality was recorded daily for 14 days after challenge. The results showed a strong protective index that correlated with dilution of the vaccine (Table 18). Twenty five (100%) of the non-vaccinated mice (Group 5) died within 14 days after challenge. In contrast, only 1 mouse (4.0%) died given the non-diluted vaccine of Group 1. Mortality increased with each 10 fold serial dilution as seen in FIG. 1 (Group 2, 8.0%), (Group 3, 48.0%) and (Group 4, 80.0%). The vaccine showed a high degree of systemic protection as compared to non-vaccinated mice of Group 5 (Placebo). The vaccine prepared from *S. enterica* serovar Newport was highly efficacious in preventing mortality associated with a lethal *S. enterica* serovar Newport challenge.

TABLE 18

Mortality of Vaccinated and Non-Vaccinated Mice Following IP Challenge with *S. enterica* serovar Newport

| Groups | # Mice | # Dead | Percent mortality (%) |
|---|---|---|---|
| Group 1 (non-diluted) | 25 | 1/25 | 4.3 |
| Group 2 (1:10) | 25 | 2/25 | 8.3 |
| Group 3 (1:100) | 25 | 12/25 | 48.0 |

TABLE 18-continued

Mortality of Vaccinated and Non-Vaccinated Mice Following
IP Challenge with *S. enterica* serovar Newport

| Groups | # Mice | # Dead | Percent mortality (%) |
|---|---|---|---|
| Group 4 (1:1000) | 25 | 15/25 | 88.0 |
| Group 5 (non-vaccinated/challenged) | 25 | 25/25 | 100.0 |

Example 6

Mouse Vaccination and Oral Challenge Study with *S. enterica* Serovar Newport

Evaluation of Fecal Shedding

In this experiment the efficacy of the *S. enterica* serovar Newport vaccine was carried out against a live oral challenge in mice. The outcome parameters used to evaluate vaccine efficacy in this experiment were 1) individual mouse mortality, and 2) differences in the concentration of *Salmonella* being shed between treatment groups after challenge. Twenty (N=20) female CF-1 mice obtained from Harlan Breeding Laboratories (Indianapolis, Ind.) weighing 16-22 grams were equally distributed into two groups (10 mice/group). Mice were housed in polycarbonate mouse cages (Ancore Corporation, Bellmore, N.Y.). Two cages were used, one for each treatment group. Groups were designated as placebo, non-vaccinated (Group 1) and vaccinated (Group 2). Food and water were supplied ad libitum to all mice.

Mice were vaccinated three times at 14 day intervals subcutaneously with the placebo and/or the *S. enterica* serovar Newport vaccines of Example 2. The volume of vaccine administered was 0.1 ml/mouse. Seven days after the third vaccination, mice in groups 1 and 2 were orally challenged with *S. enterica* serovar Newport at $2.8 \times 10^8$ colony forming units (CFU) in a volume of 0.2 cc. The challenge organism was prepared as described in example 4.

To enumerate the difference in fecal shedding between the control and vaccinated groups, mouse droppings were collected at 12, 24, 36 and 48 hours post challenge. Droppings were collected by placing a sterile pad on the floor of each cage 1 hour prior to collection. At each time period the pad was removed and placed into a laminar flow hood. Using sterilely flamed forceps, twenty individual droppings were randomly collected. The forceps were flamed between each collection so as not to cross-contaminate samples. Individual droppings were placed into sterile saline dilution blanks (0.9 ml), two droppings per tube to give ten tubes. Each sample was macerated using a sterile 1 ml pipette and serially diluted 10 fold. Dilutions were plated on Brilliant Green Sulfur Agar (Difco Laboratories, Detroit, Mich.) incubated at 37 C for 48 hours. The number of bacteria was enumerated for each sample and the $\log_{10}$ colony forming units were averaged for each treatment group at each time period.

Figure 2:
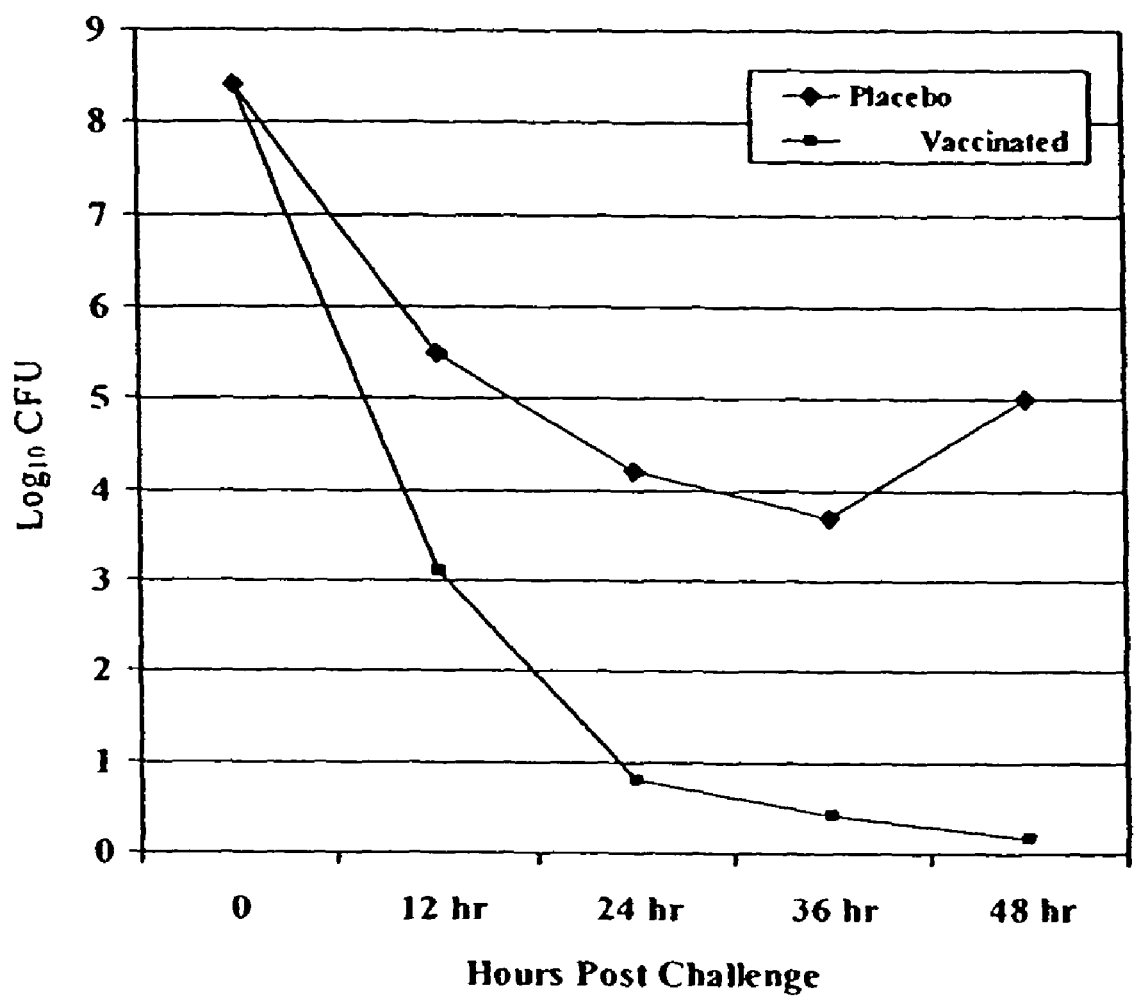
FIG. 2. The difference in fecal shedding between vaccinated and non-vaccinated mice after oral challenge with *Salmonella enterica* serovar Newport. $Log_{10}$ CFU, mean number of bacteria in fecal sample.

Table 19 shows the difference in the fecal shedding between vaccinated and non-vaccinated mice after an oral challenge with *S. enterica* serovar Newport at each time period. There was a large difference between treatment groups in the amount of *Salmonella* shedding in feces post-challenge. The challenge dose represented as time 0 in Table 4 shows the initial inoculum given to each mouse. Within twelve hours post challenge there was a dramatic decrease in the amount of *Salmonella* being shed from the vaccinated group as compared to the Placebo group. Averaged across the study period and accounting for repeated estimates, vaccinates shed less *Salmonella* at each sampling period when compared to non-vaccinates, with a degree of significance of P=0.02. The amount of *Salmonella* being shed in the vaccinated group dramatically declined with each sampling period as compared to the non-vaccinated Placebo group (FIG. 2). At 48 hours post challenge the difference in the amount of *Salmonella* being shed between the vaccinated and non-vaccinated group was greater then 4 log CFU (Table 19, FIG. 2).

TABLE 19

The Difference in Shedding of *Salmonella* Newport Between the Non-Vaccinated and Vaccinated Treatment Groups after Oral Challenge.

| | Mean $\log_{10}$ Colony Forming Units | |
|---|---|---|
| Sampling Times | Group 1 (Non-vaccinated) | Group 2 (Vaccinated) |
| Challenge Dose (time 0) | 8.4 | 8.4 |
| 12 hours | 5.5 | 3.1 |
| 24 hours | 4.2 | 0.8 |
| 36 hours | 3.7 | 0.43 |
| 48 hours | 5.0 | 0.16 |

At the 12 hour sampling period three mice (30%) died in the vaccinated group with no further mortality occurring within 14 days after challenge. Nevertheless, in the non-vaccinated Placebo group three mice died within 12 and 24 hours and 4 mice died between 48 and 56 hours (70% total). It's interesting to note that mortality seemed to be directly correlated with the amount of *Salmonella* being shed. This is illustrated in the vaccinated group where mortality occurred at an early stage where the level of *Salmonella* being shed was high (Table 19, FIG. 2). This observation was observed in both groups where three mice died within 24 hours while the amount of *Salmonella* being shed was high. However, as the incidence of shedding declined in the vaccinated group so did mortality. In contrast, as the incidence of shedding increased in the Placebo as seen at 48 hours, it appeared to be directly correlated with mortality, since 4 mice died within this time period.

Due to the unequal distribution in the number of mice between groups after 48 hours no further sampling was carried out beyond this time period. Nevertheless, the results clearly demonstrate that subcutaneous vaccination with the composition can prevent colonization by *Salmonella*. In addition, the secondary sequelae due to systemic infection was also inhibited as seen in the difference in mortality between the two groups.

Example 7

Mouse Vaccination and Oral Challenge Study with *Escherichia coli* O157:H7

Evaluation of Fecal Shedding

In this experiment, the efficacy of the *Escherichia coli* O157:H7 vaccine of example 2 was carried out against a live oral challenge in mice. The outcome parameter used to evaluate the efficacy of the vaccine in this experiment was to enumerate differences in the concentration of the challenge organism being shed between treatment groups after challenge. Twenty (N=20) female CF-1 mice obtained from Harlan Breeding Laboratories (Indianapolis, Ind.) weighing 16-22 grams were equally distributed into two groups (10 mice/group). Mice were housed in polycarbonate mouse cages (Ancore Corporation, Bellmore, N.Y.). Two cages were used, one for each treatment group. Groups were designated as placebo, non-vaccinated (Group 1) and vaccinated (Group 2). Food and water were supplied ad libitum to all mice.

Mice were vaccinated three times at 14 day intervals subcutaneously with the placebo and/or the *E. coli* O157:H7 vaccines of Example 2. The volume of vaccine administered was 0.1 ml/mouse.

Example 8

Preparation of *E. coli* O157:H7 Challenge Organism

To enhance the isolation rate of the *E. coli* O157:H7 challenge organism from fecal samples the isolate was made nalidixic acid resistant. Briefly, the isolate from a frozen stock was streaked onto Eosin Methylene Blue (EMB) agar plate and incubated at 37° C. for 18 hours. A single colony was subcultured into 50 ml Tryptic Soy Broth (Difco) containing 25 µg/ml 2,2' dipyridyl. The culture was incubated at 37° C. for 6 hours while rotating at 200 rpm, at which point was subcultured into Tryptic Soy Broth containing 25 µg/ml 2,2 dipyridyl and 100 µg/ml nalidixic acid and again incubated at 37° C. for 18 hours. One hundred microliters of the above culture containing approximately $10^8$ CFU/ml viable organisms was spread over the surface of an EMB agar plate containing 500 µg nalidixic acid. The plates were incubated at 37° C. for 48 hours and the colonies that grew were cloned by plating on EMB containing 100 µg/ml nalidixic acid. A number of nalidixic acid resistant colonies were amplified by sub-culturing into TSB containing 25 µg/ml 2,2 dipyridyl and 100 µg/ml nalidixic acid. A stable nalidixic acid resistant isolate was selected as the challenge organism by sub-culturing the isolate continuously in TSB containing 100 µg/ml nalidixic acid to enhance the stability of the organism. The outer membrane protein profile of the nalidixic acid resistant isolate expressed identical banding profiles as the parent wild type grown under iron-restriction having molecular weights of 89 kDa, 85 kDa, 81 kDa, 78 kDa and porins at 36-39 kDa. The nalidixic acid resistant isolate of *E. coli* O157:H7 was maintained as a frozen stock culture in TSB containing 25 µg/ml 2,2 dipyridyl, 100 µg/ml nalidixic acid and 20% glycerol stored at −90° C.

The nalidixic acid resistant isolate of *E. coli* O157:H7 as described above was used for challenge. The isolate from the frozen stock was sub-cultured onto an EMB agar plate containing 150 µg/ml nalidixic acid and incubated at 37° C. for 18 hours. A single colony was subcultured into 50 ml Tryptic Soy Broth (Difco) containing 25 µ/ml 2,2' dipyridyl and 250 µg nalidixic acid. The culture was incubated at 37° C. for 6 hours while rotating at 200 rpm, at which point was centrifuged at 10,000×g for 10 minutes at 4° C. to pellet the bacteria. The bacterial pellet was washed twice by centrifugation in physiological saline at 4° C. The final pellet was resuspended in 25 ml of physiological saline containing 250 µg nalidixic acid and used for challenge. Just prior to challenge, 1 ml of the above bacterial suspension was serially diluted ten fold to enumerate the number of CFU/mouse dose.

Seven days after the third vaccination, mice in groups 1 and 2 were orally challenged with 0.2 ml of the nalidixic acid resistant isolate of *E. coli* at $2.0 \times 10^8$ CFU.

To enumerate the difference in fecal shedding between the control and vaccinated groups, mouse droppings were collected at 12, 24, 36, 48, 56 and 72 hours post challenge. Droppings were collected as before by placing a sterile pad on the floor of each cage 1 hour prior to collection. At each time period the pad was removed and placed into a laminar flow hood. Using sterilely flamed forceps twenty individual droppings were randomly collected. The forceps were flamed between each collection so as not to cross-contaminate samples. Individual droppings were placed into sterile saline dilution blanks (0.9 ml), two droppings per tube to give ten tubes. Each sample was macerated using a sterile 1 ml pipette and serially diluted 10 fold. Dilutions were plated on EMB agar containing 150 µg nalidixic acid/ml incubated at 37 C for 48 hours. The number of bacteria was enumerated for each sample and the $\log_{10}$ colony forming units were averaged for each treatment group at each time period.

Figure 3:
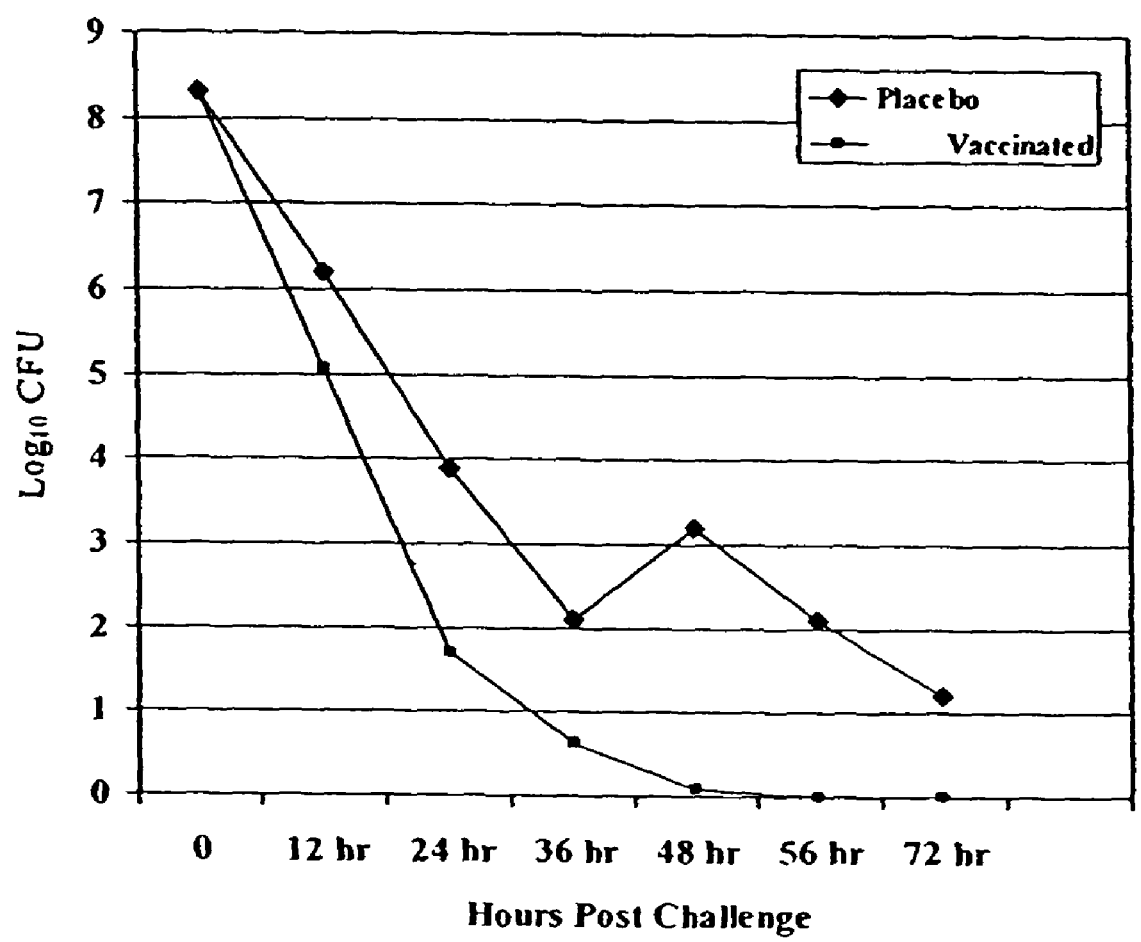
FIG. 3. The difference in fecal shedding between vaccinated and non-vaccinated mice after oral challenge with *E. coli* O157:H7. $Log_{10}$ CFU, mean number of bacteria in fecal sample.

Table 20 shows the difference in the fecal shedding between vaccinated and non-vaccinated mice after an oral challenge with the nalidixic acid resistant isolate of *E. coli*. There was a significant difference in the amount of *E. coli* O157:H7 being shed between groups at each sampling period. The challenge dose represented as time 0 in Table 20 shows the initial inoculum given to each mouse. Within twelve hours post challenge there was a dramatic decrease in the amount of *E. coli* O157:H7 being shed from the vaccinated group as compared to the Placebo group with a degree of significance of P=0.03. The amount of *E. coli* O157:H7 being shed in the vaccinated group dramatically declined with each sampling period as compared to the non-vaccinated mice (FIG. 3). Averaged across the study period, vaccinates shed approximately 2 logs less *E. coli* when compared to the non-vaccinated controls. At 56 and 72 hours post challenge the shedding incidence of the challenge organism in the vaccinated group was undetectable as compared to the non-vaccinated controls which continued to shed for the duration of the study period.

TABLE 20

The Difference in Shedding of *E. coli* O157:H7 Between the Non-Vaccinated and Vaccinated Treatment Groups after Challenge.

| | Mean $\log_{10}$ Colony Forming Units | |
|---|---|---|
| Sampling Times | Group 1 (Non-vaccinated) | Group 2 (Vaccinated) |
| Challenge Dose (time 0) | 8.3 | 8.3 |
| 12 hours | 6.2 | 5.1 |
| 24 hours | 3.9 | 1.7 |
| 36 hours | 2.1 | 0.63 |
| 48 hours | 3.2 | 0.1 |
| 56 hours | 2.1 | 0 |
| 72 hours | 1.2 | 0 |

Between the 12 and 24 hour sampling period two mice (20.0%) died in the vaccinated group with no further mortality occurring within 14 days after challenge. However, in the non-vaccinated Placebo group five mice (50.0%) died during the sampling period with no further mortality occurring after 72 hours or within the 14 day observation period.

These results demonstrate for the first time that a vaccine composition as described herein can prevent the colonization and/or growth of *E. coli* O157:H7 through a subcutaneous vaccination as well as reduce mortality due to the secondary sequelae from systemic infection.

Example 9

The Cross Protective Nature of Metal Regulated Proteins Against a Homologous and Heterologous *Salmonella* Challenge in Mice The vaccine Example 2 derived from *S. enterica* serovar Newport was evaluated against a homologous and heterologous challenge using *S. enterica* serovar Dublin in a standardized mouse model as described in the Code of Federal Regulations, Title 9, section 113.123.

Two hundred ten (N=210) female Harlan CF-1 mice obtained from Harlan Breeding Laboratories (Indianapolis, Ind.) weighing 16-22 grams were equally divided into 9 treatment groups (20 mice/group) designated as groups 1-9. The efficacy of each vaccine was tested at four different concentrations. The whole cell *S. enterica* serovar Dublin reference bacterin as described in example 2 was administered to four groups designated as groups 1-4; Group 1 (non-diluted, 50 µg total protein), Group 2, (1:10 dilution, 5.0 µg total protein), Group 3, (1:100 dilution, 0.5 µg total protein) and Group 4, (1:1000 dilution, 0.05 µg total protein). The *S. enterica* serovar Newport vaccine was also administered at the same dilutions as described above in the same number of mice, designated as groups 5-8 Group 5 (non-diluted), Group 6 (1:10), Group 7 (1:100) and Group 8 (1:1000) respectively. Group 9 was the control group that was not vaccinated, but challenged. Since the *Salmonella* reference bacterin was prepared using whole cells and supplied from an outside source the protein concentration was unknown. EMULISIGEN was used as the diluent for diluting the composition prepared using MS020508 (ATCC Accession No. PTA-9496) at a 22.5% concentration prepared in physiological saline. The *S. enterica* serovar Dublin reference bacterin was diluted using phosphate buffered saline (PBS). All mice in groups 1-4 and 5-8 were vaccinated with the appropriate vaccine intraperitoneally and revaccinated 14 days after the first vaccination. The volume administered was 0.25 ml per mouse.

Fourteen days after the second vaccination, all mice in groups 1-9 were intraperitoneally challenged with $9.8 \times 10^7$ colony forming units (CFU) of a virulent *Salmonella enterica* serovar Dublin isolate to evaluate the cross-protective nature of the *S. enterica* serovar Newport vaccine against a *S. enterica* serovar Dublin challenge (*S. enterica* serovar Newport vaccinated/*S. enterica* serovar Dublin challenged) compared to the homologous group (*S. enterica* serovar Dublin vaccinated/*S. enterica* serovar Dublin challenged) The virulent *Salmonella enterica* serovar Dublin isolate was obtained from The Center of Veterinary Biologics-Laboratory (IRP SDC #5, United States Department of Agriculture, Ames, Iowa). Mortality was recorded daily for 2 weeks post-challenge. Table 21 shows the percent mortality in mice following a homologous and/or heterologous challenge with *S. enterica* serovar Dublin.

TABLE 21

Mortality in mice following a homologous and/or heterologous challenge with *Salmonella* Dublin

| Groups | # Mice | # Dead | Percent mortality (%) |
|---|---|---|---|
| Groups 5-8 (Reference Bacterin Vaccinated/Challenged with *S. enterica* serovar Dublin) Homologous Challenge | | | |
| Group 5 (non-diluted) | 20 | 10/20 | 50 |
| Group 6 (1:10) | 20 | 11/20 | 55 |
| Group 7 (1:100) | 20 | 16/20 | 80 |
| Group 8 (1:1000) | 20 | 16/20 | 80 |
| Group 9 (non-vaccinated) | 20 | 20/20 | 100 |
| Groups 1-4 (*S. enterica* serovar Newport composition Vaccinated/Challenged with *S. enterica* serovar Dublin) Heterologous Challenge | | | |
| Group 1 (non-diluted) | 20 | 10/20 | 50 |
| Group 2 (1:10) | 20 | 17/20 | 85 |
| Group 3 (1:100) | 20 | 20/20 | 100 |
| Group 4 (1:1000) | 20 | 18/20 | 90 |

Twenty (100%) of the non-vaccinated mice (Group 9) died within 3 days after challenge (Table 21). Mice vaccinated with the composition derived from *S. enterica* serovar Newport and challenged with *S. enterica* serovar Dublin showed a high degree of cross-protection (Group 1) when compared to mice vaccinated with the *S. enterica* serovar Dublin reference bacterin (Group 5). There was no difference in mortality between these two groups. This data shows that the composition derived from *S. enterica* serovar Newport was protective against a live *S. enterica* serovar Dublin challenge as compared to the non-vaccinated control mice. Further, the composition derived from *S. enterica* serovar Newport protected against a different serogroup of *Salmonella* showing heterologous protection: *S. enterica* serovar Newport is typed as serogroup $C_2$ whereas *S. enterica* serovar Dublin is a $D_1$ serogroup.

The results from this study provide strong evidence that the composition includes highly protective antigens that protect against a homologous and heterologous *Salmonella* challenge in mammals.

Example 10

Experimental *S. enterica* Serovar Newport Challenge in Calves

The purpose of this study was to evaluate the efficacy of the *Salmonella* Newport vaccine described in Example 2 against a homologous *S. enterica* serovar Newport challenge in calves. The parameters used to evaluate vaccine efficacy were 1) individual calf morbidity as evidenced by rectal temperature, and 2) serological response to vaccination and quantitative enumeration of fecal shedding of *S. enterica* serovar Newport.

Thirty male Holstein steers (N=30) 4 to 6 months of age were randomly assigned to two treatment groups, designated as Group 1 and Group 2. Group 1, which consisted of 20 steers, received the immunizing composition derived from *S. enterica* serovar Newport strain MS020508 (ATCC Accession No. PTA-9496) as described in Example 2. Steers in Group 2, which consisted of 10 steers (N=10), were vaccinated with a placebo (control group) made by preparing the immunizing composition of example 2 without the addition of the composition derived from *S. enterica* serovar Newport. The antigen in the control formulation was replaced with saline while keeping the adjuvant concentration the same (22.5%). All calves in groups 1 and 2 were vaccinated with the appropriate vaccine subcutaneously and revaccinated 21 days after the first vaccination.

Example 11

Blood and Fecal Sample Collection

Blood samples were collected from all steers on day 7 and again at 28, 42 and 49 days after the first vaccination. The second vaccination was 28 days after the first vaccination. All blood was collected in sterile 13×75 mm vacutainer collection tubes, (SST No. 369783, Becton Dickinson, Franklin Lakes, N.J.). After clotting the blood tubes were centrifuged at 800×g for 30 minutes and frozen at −20° C. until analysis.

Individual fecal samples were taken aseptically by rectal extraction using sterile shoulder length gloves and placed in sterile whirl pack bags. Fecal samples were taken from all steers at three day intervals (3, 6, 9, 12, 15 and 18) (Table 22).

Ten grams of feces from each sample was placed into 90 ml of Bismuth Sulfate Broth (BSG) (Difco). Samples were mixed thoroughly and serially diluted ten fold ($10^{-2}$ to $10^{-6}$) using BSG as diluent. Samples were incubated at 37 C for 24 hours. The end point for each sample was enumerated by plating in duplicate each dilution on Brilliant Green *Salmonella* selective agar. Positive cultures were confirmed by agglutination using *Salmonella* O antiserum (poly A-I and Vi). The highest dilution that had a positive *Salmonella* culture was determined as the end point.

TABLE 22

Schedule of Events

| Daily Schedule | Description of Events |
| --- | --- |
| Day (−20) to day (−1) | Calves were purchased from a local sales barn and upon entering trial facility were treated as necessary for respiratory or enteric disease, and treated for internal and external parasites. |
| Day 0 (1st vaccination) | Calves were ear-tagged, randomized, and assigned to group A or B. Each calf received an initial vaccination with the appropriate vaccine (test and/or placebo) subcutaneously in the neck. Serum and fecal samples were collected. |
| Day 1, 7, 14 | Monitored for adverse reactions to vaccination (local and systemic). |
| Day 21 (2$^{nd}$ Vaccination) | Appropriate booster vaccination (test or placebo) was given to each calf (second vaccination). Serum samples collected. |
| Day 22, 28, 37 | Monitored for adverse reactions to vaccination (local and systemic). |
| Day 37 | All groups were orally challenged with $10^{12}$ CFU of *S. enterica* serovar Newport challenge organism. Calves weighed and serum samples collected. |
| Days 38-55 | Animals were monitored daily for morbidity and mortality. Dead calves were examined post-mortem and internal organs cultured for salmonella to confirm cause of death. Feces from all surviving calves were sampled every 3 days and cultured for recovery of Salmonella. |
| Day 56 | Termination of trial. Remaining calves were weighed, serum collected, and treated if necessary. Group B calves were vaccinated with *S. enterica* serovar Newport bacterial vaccine. All surviving calves were returned to a normal cattle production environment. |

Example 12

Preparation of *S. enterica* Serovar Newport Challenge Organism

A frozen culture of *S. enterica* serovar Newport challenge organism (MS020508, ATCC Accession No. PTA-9496) was streaked on a Blood agar plate and incubated at 37° C. Several isolated colonies were transferred onto 100 ml of Tryptic Soy Broth (TSB) containing 25 μg/ml 2,2' dipyridyl and incubated on and orbital shaker at 200 rpm/min for 12 hours. Twenty five milliliters of this culture was transferred into 3500 ml of pre-warmed TSB. The culture was incubated at 37° C. for 5 hours at which point the cells were collected by centrifugation at 10,000×g for 20 minutes. The bacterial pellet was washed twice by centrifugation with the final pellet resuspended into 3000 ml of sterile physiological saline (0.85%). Just prior to challenge, 1 ml of the above bacterial suspension was serially diluted ten fold to enumerate the number of CFU per ml.

Example 13

*S. enterica* Serovar Newport Challenge in Holstein Calves

Sixteen days after the second vaccination all calves were orally lavaged with 100 ml of the above bacterial suspension containing $1.0\times10^{12}$ Colony Forming Units (CFU) of *S. enterica* serovar Newport. Calves were monitored daily for signs of morbidity and rectal temperatures for 18 days post-challenge. Rectal temperatures were taken at three day intervals. Fecal samples were collected approximately every 3 days for the isolation of *Salmonella*. Rectal temperature and the quantitative enumeration of *Salmonella* was analyzed using linear regression, while the likelihood of being culture-positive (yes/no) was analyzed using logistic regression.

Example 14

Enzyme-Linked Immunosorbent Assay (ELISA)

An Enzyme-Linked Immunosorbent Assay (ELISA) was used to monitor the serological response to vaccination. Three highly conserved proteins present in the composition prepared as described in Example 1 were used. Briefly, the proteins migrating at 82 kDa, 80 kDa, and 74 kDa were cut from unstained polyacrylamide gels. The location of these proteins was determined using a stained indicator lane which was cut away from the original gel and stained. Elution of the protein from the macerated gel was carried out according to the manufacturer's recommendation using a model 422 electro-eluter (Bio-Rad, Laboratories, Hercules, Calif.). These proteins were then used as the capture molecule in an indirect ELISA test. A polyclonal antiserum was raised against the composition derived from *S. enterica* serovar Newport as described in Example 1 and used as the ELISA positive control serum.

The optimum working concentrations of the purified protein and chromogenic conjugate was determined by several checkerboard titrations using the positive and negative control dialysates. A prediction curve was then established to calculate protein-ELISA titers at a 1:500 dilution. All subsequent tests were performed at a single serum dilution (1:500) and protein titers were calculated as an average of the test absorbance values for each treatment.

The ELISA was performed by adding 100 μl of diluted protein in 0.05M carbonate buffer (pH 9.6) to each well of a 96-well flat bottom plate (IMMULON 2, Dynex Technologies). After overnight incubation at 4° C., excess protein was removed and the plate was washed. All subsequent washing steps were done three times in phosphate buffered saline (pH 7.4) with 0.05% TWEEN-20. The plates were blocked for one hour at 37° C. with 4% fish gelatin (Sigma) in PBS and then washed. Serum samples were tested in parallel at single-point dilutions (1:500) using 100 μl/well and incubated for 45 minutes at 37° C. The first two columns of each plate contained the negative and positive control samples while the rest of the plate was used for the test samples. The plate was incubated for 45 minutes at 37° C. while stirring at 200 rpm. After washing, 100 µl of a Monoclonal Anti-bovine IgG clone BG-18 Alkaline phosphatase conjugate (Sigma Chemical) at a 1:15,000 dilution was added to each well. After incubation for 45 minutes at 37° C., the plates were washed and 100 µl PnPP substrate (Sigma Chemical), prepared in 0.1 M glycine buffer, was added to each well. The substrate was allowed to react for 45 minutes at 37° C. while stirring at 100 rpm. The reaction was terminated by the addition of 25 ul of 3.0 N NaOH. The absorbance was read at 405 nm.

Example 15

Results

Figure 4:
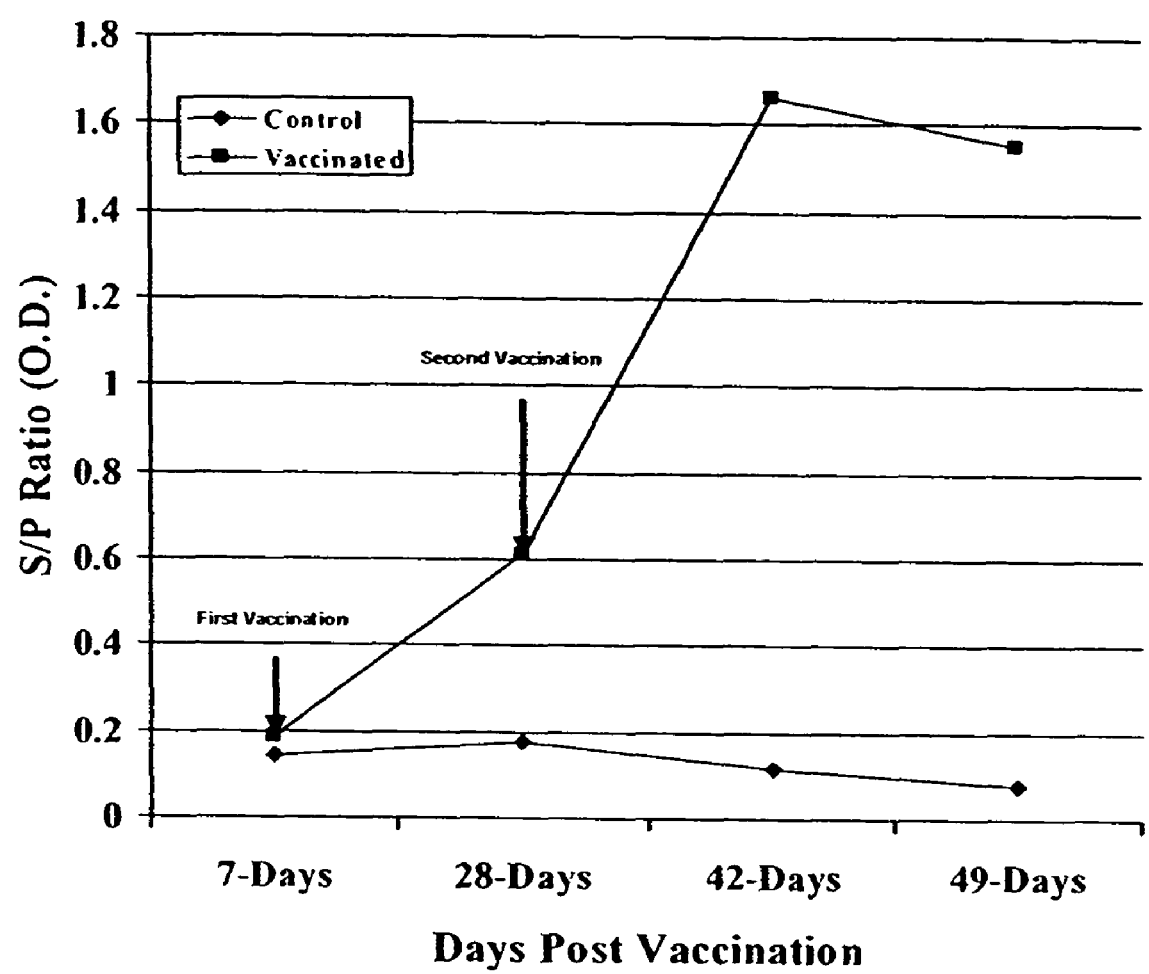
FIG. 4. The serological response in vaccination with a composition derived from *S. enterica* serovar Newport compared to non-vaccinated controls as evaluated by ELISA.

Calves vaccinated with the composition derived from *S. enterica* serovar Newport showed an enhanced serological response to vaccination which increased after the second vaccination showing an anamnestic response after the second vaccination (FIG. 4). In contrast, the placebo non-vaccinated control calves showed no antibody response.

There was a significant difference between the rectal temperature of the vaccinates (Table 23) compared to the non-vaccinated calves (Placebo) during the post challenge period (Table 24). Averaged across the study period the rectal temperatures for the non-vaccinates was approximately 0.4 F (95% CI=0.01-0.79 F) higher when compared to vaccinates (P=0.045).

TABLE 23

The Rectal Temperature of Vaccinated Calved following an Oral Challenge with *Salmonella enterica* serovar Newport

| Calf # | Days Post Challenge | | | | | | | | |
|---|---|---|---|---|---|---|---|---|---|
| | 0 | 3 | 4 | 5 | 6 | 9 | 12 | 14 | 18 |
| 2 | 103 | 105.1 | 104.8 | 103.7 | 103.7 | 103.7 | 103.1 | 103.5 | 102.4 |
| 3 | 103.1 | 103.9 | 104.2 | 103.9 | 103.5 | 103.7 | 103.7 | 103.3 | 102.4 |
| 5 | 103.3 | 105.1 | 103.7 | 105.5 | 103.5 | 104.2 | 103 | 03.1 | 102.4 |
| 6 | 105.1 | 104.2 | 103.9 | 104.9 | 102.4 | 103.3 | 103 | 102.4 | 102.2 |
| 8 | 103.1 | 104.6 | 103.3 | 104.6 | 102.6 | 103.7 | 103.3 | 102.5 | 101.9 |
| 9 | 103.3 | 104.2 | 104.2 | 103 | 103.1 | 104.6 | 103 | 102.2 | 102.8 |
| 11 | 102.8 | 106.4 | 103.3 | 103.3 | 101.5 | 103 | 103.3 | 103 | 101.5 |
| 12 | 103.3 | 105.8 | 105.1 | 103.9 | 102.6 | 103 | 102.8 | 102.2 | 101.9 |
| 14 | 103.7 | 105.1 | 103 | 103.5 | 103 | 105.1 | 104.8 | 103.3 | 103.3 |
| 15 | 105.5 | 104.2 | 103.7 | 103.5 | 102.4 | 103 | 102.4 | 102.6 | 102.4 |
| 17 | 103.7 | 105.1 | 103.9 | 104.2 | 102.4 | 103.3 | 103.3 | 102.4 | 101.3 |
| 18 | 103.5 | 106.2 | 104.9 | 105.1 | 101.7 | 103 | 103.5 | 103.3 | 103.3 |
| 20 | 103.5 | 106.6 | 105.3 | 106.2 | 102.8 | 103.3 | 104.2 | 103.3 | 103.7 |
| 21 | 103.3 | 104.8. | 103.3 | 102.2 | 103 | 104 | 103.3 | 103 | 101.3 |
| 23 | N/S | 105.5 | 105.8 | 103.3 | 102.4 | 103.7 | 103.1 | 102.4 | 102.1 |
| 24 | N/S | 105.1 | 105.5 | 104.4 | 103.3 | 103.3 | 103.3 | 102.4 | 102.2 |
| 26 | 102.8 | 103.9 | 103.5 | 103.5 | 105.1 | 103.7 | 103.3 | 102.4 | 101.4 |
| 27 | 103 | 104.2 | 103.3 | 103.7 | 103.3 | 103.3 | 103.3 | 103.7 | 102.4 |
| 29 | 103.3 | 105.5 | 104 | 105.5 | 105.5 | 106 | 104.6 | 103 | 103.3 |
| Mean | 103.5 | 105.0 | 104.1 | 104.1 | 103.0 | 103.8 | 103.4 | 103 | 103.3 |

Cumulative Mean = 103.6
Standard Deviation = 0.64

TABLE 24

The Rectal Temperature of Placebo-Vaccinated Calves following an Oral Challenge with *Salmonella enterica* serovar Newport

| Calf# | Days Post Challenge | | | | | | | | |
|---|---|---|---|---|---|---|---|---|---|
| | 0 | 3 | 4 | 5 | 6 | 9 | 12 | 14 | 18 |
| 1 | 103.7 | 106.9 | 105.1 | 105.1 | 103.3 | 104.4 | 103.3 | 102.6 | 102.2 |
| 4 | 104.2 | 106.6 | 105.7 | 104.9 | 103.9 | 104.8 | 104.4 | 103.3 | 102.4 |
| 7 | 103.7 | 106.4 | 105.7 | 103.3 | 102.8 | 103.7 | 104.2 | 103.3 | 103.9 |
| 10 | 103.1 | 104.9 | 103.3 | 104.2 | 103 | 103.7 | 102.2 | 102.4 | 101.9 |
| 13 | 103.3 | 106.6 | 105.5 | 104.2 | 103 | 105.1 | 104.2 | 102.1 | 103.3 |
| 16 | 103.7 | 106 | 104 | 103 | 102.2 | 103.7 | 102.6 | 102.2 | 102.1 |
| 22 | 103.5 | 107.5 | 106.7 | 105.7 | 104.8 | 105.1 | 103.3 | 103.3 | 104.8 |
| 25 | 102.8 | 106.9 | 102.8 | 103.3 | 102.4 | 104.9 | 103.5 | 103.3 | 103.3 |
| 28 | 104.8 | 105.5 | 104.2 | 103.9 | 103.1 | 104.2 | N/A | N/A | N/A |
| Mean | 103.5 | 106.5 | 104.9 | 104.1 | 103.2 | 104.4 | 103.5 | 102.8 | 103 |

Cumulative Mean = 104.0
Standard Deviation = 1.16

Figure 5:
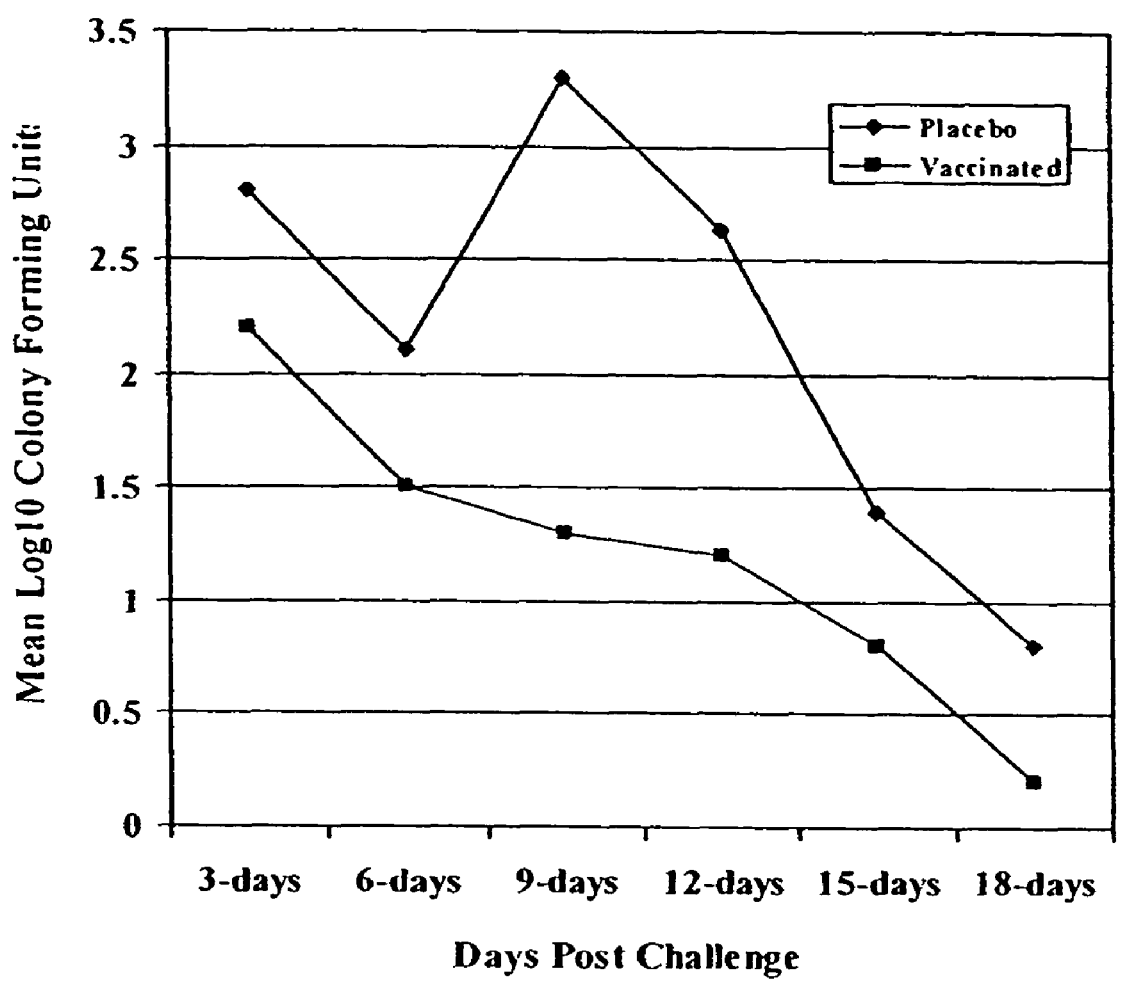
FIG. 5. The difference in fecal shedding between vaccinated and non-vaccinated calves after oral challenge with a composition derived from *S. enterica* serovar Newport.

There was a significant difference in the amount of *Salmonella* being shed between the vaccinated group compared to the non-vaccinated Placebo group after challenge (FIG. 5). Averaged across the study period and accounting for repeated estimates, vaccinates shed less *Salmonella* per gram of feces as compared to non-vaccinates (average $\log_{10}$=0.91, 95% CI $\log_{10}$=0.17-64, P=0.04). Overall, among vaccinates there were about twice as many culture-negative days. About 40% of cultured days were negative for vaccinates (55/162) compared to non-vaccinates with 21% of cultures days were negative (10/48). These data show that the odds of being culture-positive for *Salmonella* among non-vaccinates was approximately 2.5 times greater when compared to the vaccinated group (OR=2.5, 95% CI=1.24-4.93, P=0.02). These data illustrate the proof of concept that a composition administered through vaccination prevented the colonization of *Salmonella* in calves after experimental challenge.

Example 16

Decreased Fecal Shedding of *E. coli* O157:H7 Through Vaccination in Holstein Steers The purpose of this study was to evaluate the efficacy of the composition derived from *E. coli* O157:H7 in eliminating the fecal shedding of a homologous oral challenge of *E. coli* O157:H7 in Holstein steers. The immunizing composition was prepared from *E. coli* O157:H7 as described in Examples 1 and 2. The experimental trial was initiated in starter calves on a commercial feed lot. The feed lot consisted of 500 Holstein steers separated into separate grow out facilities based on the age and weight of the steers. Twelve steers (N=12) with an average weight of approximately 300 pounds were randomly selected and distributed into a single pen. Steers were ear tagged for identification and randomly allocated into three groups designated as groups 1-3. Steers in Group 1 were designated as non-vaccinated and remained as the control group. Steers in groups 1 and 2 were given two different vaccine formulations prepared in using two different adjuvant formulations. Steers in Group 2 were vaccinated with the vaccine adjuvanted with EMULSIGEN as described previously in Example 2, while steers in Group 3 were vaccinated with the vaccine prepared in aluminum hydroxide (REHYDRAGEL HPA, Reheis, N.J.). Briefly, the composition was suspended in 0.02M phosphate buffered saline pH 7.2 and absorbed onto aluminum hydroxide (25% vol/vol) to provide a total dose of 1000 µg in a 2 ml injectable volume. Steers were vaccinated subcutaneously 3 times at 21 day intervals. The outcome parameters used to evaluate vaccine efficacy were frequency and concentration of fecal shedding of the challenge organism, serological response to vaccination, and injection site reactions.

Example 17

Blood and Fecal Sample Collection

Blood samples were collected from all test steers on the initial day of immunization (day-0) and again at 7, 14, 21, 28, 35, 42, and 54 days after the first vaccination to monitor the serological response to vaccination. An Enzyme-Linked Immunosorbent Assay (ELISA) monitored the serological response to vaccination as described in Example 14 with the following modification: metal regulated proteins derived from *E. coli* O157:H7 having molecular weights of 89 kDa, 85 kDa, 81 kDa, 78 kDa, were used as the capture molecule in the assay. All blood was collected in sterile 13×75 millimeter vacutainer collection tubes (SST No. 369783, Becton Dickinson, Franklin Lakes, N.J.). After clotting, the blood tubes were centrifuged at 800×g for thirty minutes and frozen at −20° C.

Individual fecal samples were taken aseptically by rectal extraction using sterile shoulder length gloves and placed in sterile whirl pack bags. Fecal samples were taken from all steers on the initial day of challenge and again at 12, 24, 48, 72, 96, 120, 144 and 168 hours post challenge. Briefly, ten grams of feces from each sample was placed into 90 ml of physiological saline (0.85%). Samples were mixed thoroughly and serially diluted 10-fold in saline. Each dilution was plated in duplicate on Eosin Methylene Blue Agar (EMB) agar containing 150 µg nalidixic acid/ml incubated at 37° C. for 48 hours. The number of bacteria was enumerated for each sample and the $log_{10}$ colony forming units was averaged for each treatment group at each time period.

Seven days after the third vaccination steers were transported from the commercial feedlot to a Biosafety level 2 isolation facility. Steers were equally divided among three isolation rooms so that each room had at least one treatment group. Four days after arriving at the isolation facility all steers were challenged. Twelve hours prior to challenge feed and water was removed from each isolation room. The *E. coli* O157:H7 isolate as described in Example 1 was used for challenge.

Example 18

Preparation of *E. coli* O157:H7 Challenge Organism

To enhance the isolation rate of the *E. coli* O157:H7 challenge organism from fecal samples the nalidixic acid resistant isolate as described in Example 8 was used for challenge. Forty eight hours before challenge the isolate was removed from a frozen stock and sub-cultured onto an EMB agar plate containing 150 µg/ml nalidixic acid and incubated at 37° C. for 18 hours. A single colony was subcultured into 100 ml Tryptic Soy Broth (Difco) containing 25 µg/ml 2,2' dipyridyl and 150 µg nalidixic acid. The culture was incubated at 37° C. for 12 hours while rotating at 200 rpm, at which point was subcultured into 4 liters Tryptic Soy Broth (Difco) containing 25 µg/ml 2,2' dipyridyl and 150 µg nalidixic acid incubated at 37° C. for 6 hours while continuously stirring. At the end of the incubation period the culture was centrifuged at 10,000×g for 20 minutes at 4° C. to pellet the bacteria. The final bacterial pellet was resuspended in 3600 ml of phosphate buffered saline containing 250 µg/ml nalidixic acid. Just prior to challenge, 1 ml of the above bacterial suspension was serially diluted ten fold to enumerate the number of CFU/calf dose.

Example 19

*E. coli* O157:H7 Challenge in Holstein Calves

All steers were orally lavaged with 100 ml of the above bacterial suspension containing $4.5 \times 10^9$ CFU. To enumerate the difference in fecal shedding between the control and vaccinated steers, individual fecal samples were collected aseptically by rectal extraction at the time of challenge and again at 12, 24, 48, 72, 96, 120, 144 and 168 hours post challenge. Blood samples were taken at the time of challenge and again at termination of the trial (168 hours).

Figure 6:
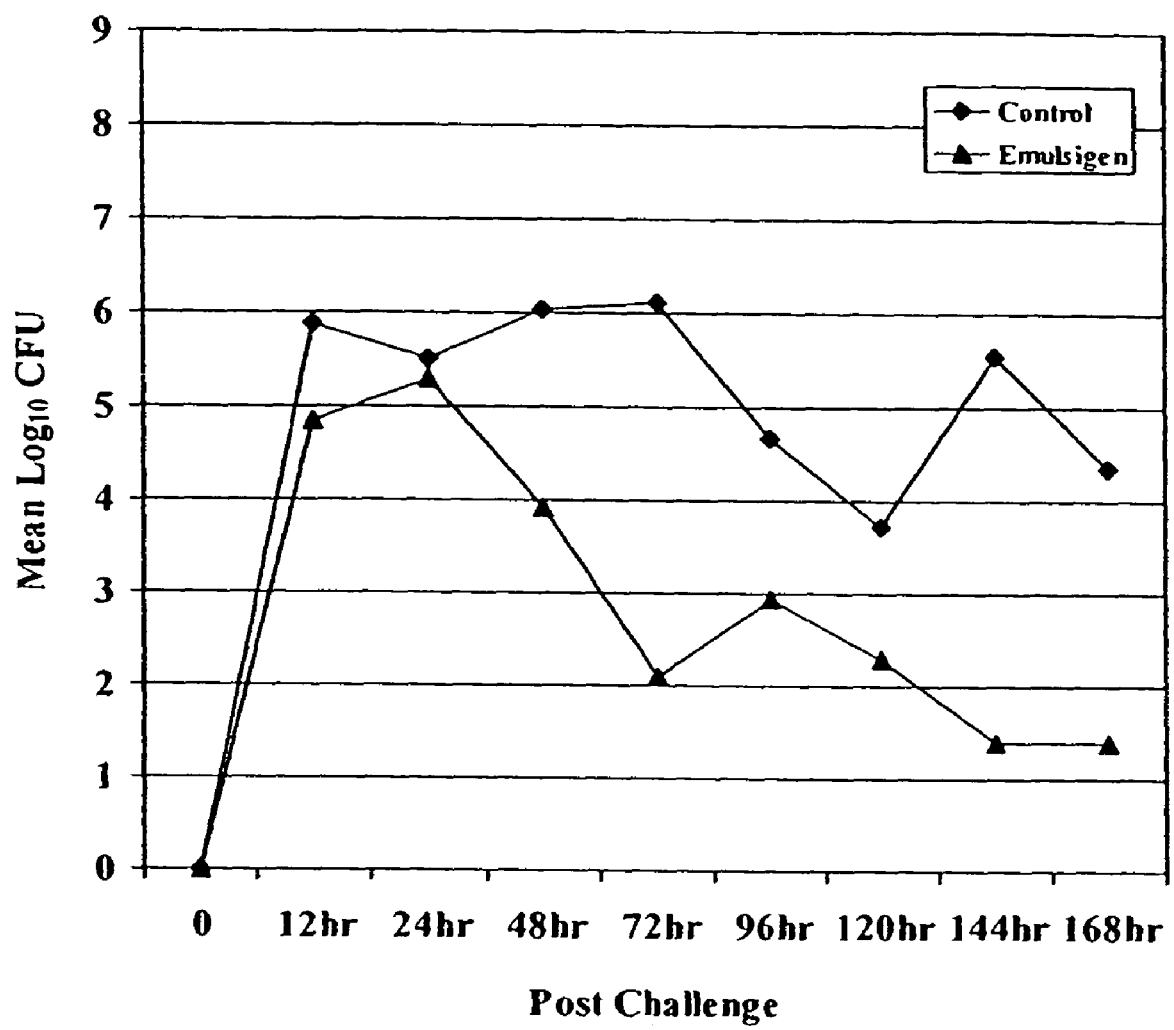
FIG. 6. The difference in fecal shedding between vaccinated and non-vaccinated steers after oral challenge with a nalidixic acid resistant *E. coli* O157:H7.

Table 25 shows the difference in the fecal shedding between the non-vaccinated controls (Group 1) and the vaccinated steers (Groups 2 and 3). There was a highly statistical difference in the amount of *E. coli* O157:H7 being shed between the steers in Group 2 as compared to the non-vaccinated/challenged controls. Averaged across the study period, steers in Group 2 shed less *E. coli* per gram of feces as compared to the non-vaccinated steers of Group 1, with a degree of significance of P=0.02 FIG. 6.

TABLE 25

The Difference in Shedding of *E. coli* O157:H7 Between the Non-Vaccinated and Vaccinated Treatment Groups after Challenge

| Sampling Times | Mean $log_{10}$ Colony Forming Units | | |
| --- | --- | --- | --- |
| | Group 1 (Non-Vaccinated) | Group 2 (Vaccinated)[1] | Group 3 (Vaccinated)[2] |
| Challenge (Time 0) | 9.7 | 9.7 | 9.7 |
| 12 hours | 5.89 | 4.84 | 5.7 |
| 24 hours | 5.51 | 5.3 | 4.77 |
| 48 hours | 6.03 | 3.92 | 4.44 |
| 72 hours | 6.12 | 2.1 | 5.4 |
| 96 hours | 4.68 | 2.94 | 5 |
| 120 hours | 3.72 | 2.3 | 5.4 |
| 144 hours | 5.55 | 1.4 | 4.4 |
| 168 hours | 4.36 | 1.4 | 4.03 |

[1]Steers in treatment Group 2 were vaccinated with the composition formulated in the EMULSIGEN adjuvant (22.5% vol/vol).
[2]Steers in treatment Group 3 were vaccinated with the composition formulated in aluminum hydroxide (25% vol/vol).

Figure 7:
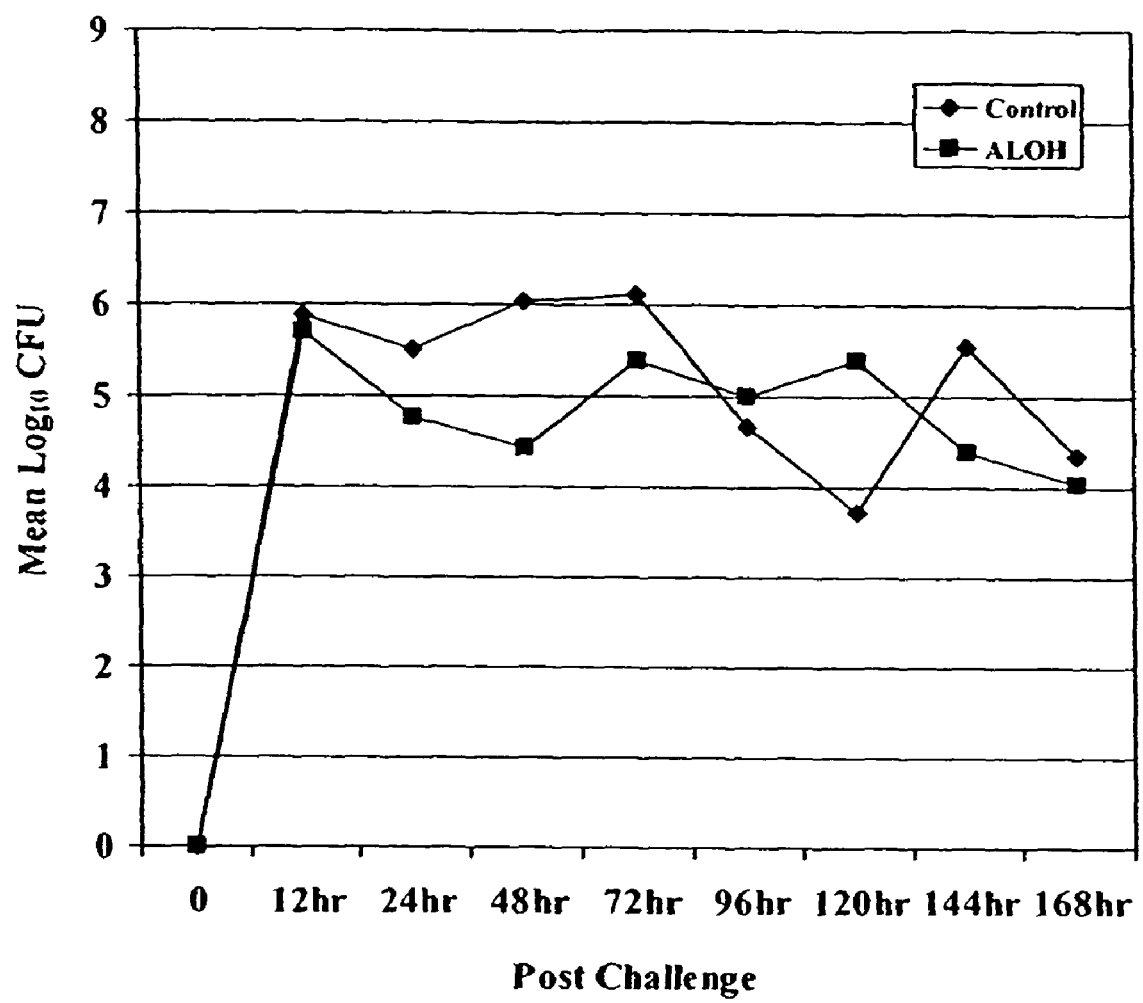
FIG. 7. The difference in fecal shedding between vaccinated and non-vaccinated steers after oral challenge with a nalidixic acid resistant *E. coli* O157:H7.

There was no statistical difference in the fecal shedding between the non-vaccinated controls as compared to the shedding incidence of steers in Group 3 given the vaccine prepared in aluminum hydroxide (FIG. 7). This difference could possibly be explained due to the different adjuvants. It is well known that oil based adjuvants often provide a much better immune response than aluminum hydroxide based adjuvants and could simply be due to a difference in antibody response. Nevertheless, these data illustrate for the first time that a composition as described herein administered as a vaccine composition can prevent the colonization of *E. coli* O157:H7 in calves after experimental challenge given orally.

Example 20

Preparation of the Immunizing Compositions Derived from *Salmonella enterica* Serovar Enteritidis Metal regulated proteins were prepared from *S. enterica* serovar Enteritidis using the methods described in Example 1.

The bacterial isolate used in this experimental study originated from a natural field outbreak in a commercial chicken layer flock. Identity of the isolate was confirmed by the Minnesota Poultry Testing Laboratory located in Willmar, Minn. and designated as MS010531. The composition prepared from this isolate (*S. enterica* serovar Enteritidis) contained the proteins described in Table 3. Two stock vaccines were prepared that represented standard adjuvant formulations used in the poultry industry; a water-in-oil emulsion and an aqueous aluminum hydroxide formulation. The water-in-oil formulation was prepared by suspending the protein suspension in physiological saline (0.85%) containing 0.1% formalin. The protein concentration was standardized to contain 100 ug of protein per bird dose. Briefly, the aqueous protein suspension 250 ml was emulsified in a water-in-mineral oil adjuvant containing 50% DRAKEOL 6 mineral oil (Univar USA, St. Paul Minn.), 44.5% aqueous protein suspension, 2.56% TWEEN 85 (Ruger Chemical Co, Irvington, N.J.) and 3.0% SPAN 85 (Ruger Chemical Co, Irvington, N.J.). The mixture was emulsified using an ULTRA-TURRAX T-50 homogenizing vessel (IKA, Cincinnati, Ohio). The water-in-oil emulsion was stored at 4° C.

The aqueous aluminum hydroxide formulation was prepared by suspending the *S. Enteritidis* antigen in 0.02M phosphate buffered saline pH 7.2 to a final volume of 250 ml containing 25% vol/vol aluminum hydroxide (REHYDRAGEL HPA, Reheis, N.J.) to give a final protein concentration of 200 ug protein/ml.

Example 21

Chicken Vaccination and Challenge Study

Evaluation of the efficacy of the *S. enterica* serovar Enteritidis vaccines was carried out against a live virulent challenge in Specific Pathogen Free Chickens (SPF). Three hundred and fifty (N=350) 1-day old SPF chicks were obtained from Charles River Spafas Inc (Roanoke, Ill.). Chicks were randomly assigned to three treatment groups, designated A, B, and C, with 116 birds in each group. Birds in Group A received a 0.1 ml dose, delivered subcutaneously, of the aluminum hydroxide adjuvant vaccine at day one, followed by a 0.5 cc booster at 10 weeks of age (day 70). Birds in Group B received a 0.5 cc dose, delivered subcutaneously, of the oil emulsified vaccine at 6 weeks of age (Day 42), followed by a 0.5 cc booster vaccination at 10 weeks of age (Day 70). Group C served as non-vaccinated controls.

Example 22

Intravenous Challenge with S. enteritidis Serovar Enteritidis

To enhance the isolation rate of the *S. enterica* serovar Enteritidis challenge organism from challenged birds the isolate was made nalidixic acid resistant as described in example 8 with the following modification. The *S. enterica* serovar Enteritidis culture was plated on Brilliant Green Agar (BG) plates rather then Eosin Methylene Blue (EMB). The nalidixic acid resistant *S. enterica* serovar Enteritidis isolate as prepared by the method described above was stored at −90° C. until used for challenge. Briefly, the isolate from a frozen stock was streaked onto a blood agar plate and incubated at 37° C. for 18 hours. A single colony was subcultured into 100 ml Tryptic Soy Broth (Difco) containing 25 µg/ml 2,2' dipyridyl. The culture was incubated at 37° C. for 12 hours while rotating at 200 rpm, at which point 10 ml was sub-cultured into 500 ml pre-warmed Tryptic Soy Broth containing 25 µg/ml 2,2' dipyridyl. The culture was incubated at 37° C. for 6 hours while rotating at 200 rpm at which point it was centrifuged at 10,000×g for 10 minutes at 4° C. to pellet the bacteria. The bacterial pellet was washed twice by centrifugation in physiological saline at 4° C. The final pellet was resuspended and aliquated into two 200 ml samples in physiological saline. Each sample was adjusted to give a low and high challenge dose, i.e. low dose was adjusted to $3.45\times10^7$ CFU/ml while the high dose was adjusted to give $3.45\times10^9$ CFU/ml.

Example 23

Challenge

At 12 weeks of age (day 84), all groups (A, B, and C) were separated into two sub-groups based on the challenge dose given, i.e. Group A was designated as $A_1$ and $A_2$ while birds in Groups B and C were designated as $B_1$, $B_2$, $C_1$ and $C_2$ respectively. All birds in groups $A_1$, $B_1$, and $C_1$ (60 birds/group) were intravenously challenged using the low dose of *S. enterica* serovar Enteritidis. Each bird was given 1 ml containing $3.45\times10^7$ CFU by intravenous injection (refer to table 26). The outcome parameters used to evaluate vaccine efficacy in these groups was based on the differences in the quantitative clearance of the challenged organism from internal organs (spleen and ovaries) and difference in fecal shedding as examined by culturing the cecal junction. Birds in Groups $A_2$, $B_2$, and $C_2$ (40 birds/group) were intravenously challenged with the high dose of *S. enterica* serovar Enteritidis ($3.45\times10^9$ CFU/ml) to evaluate the difference in mortality between vaccinated and non-vaccinated treatment groups. Mortality was recorded daily for 7 days (table 26).

TABLE 26

Treatment Groups, Adjuvants, and Antigen Doses

| Treatment Group | # of Birds: Low chlg. | # of Birds: High chlg. | Adjuvant Formulation | Antigen Treatments | Priming Dose | Booster Dose | Administration Day |
|---|---|---|---|---|---|---|---|
| Group A | 60 + 40 | | Al—OH | 20 and 100 µg | 0.1 ml | 0.5 ml | Days 1, 70 |
| Group B | 60 + 40 | | Oil Emulsion | 100 and 100 µg | 0.5 ml | 0.5 ml | Days 42, 70 |
| Group C | 60 + 40 | | non-vac | non-vac | — | — | — |

To enumerate differences in systemic clearance of the challenge microbe from internal organs and intestinal colonization between vaccinates and non-vaccinates challenged with the low dose, ten birds/group were euthanized by $CO_2$ at 12, 24 and 48 hours after challenge and the spleen, left ovary and cecal junction were aseptically removed from each bird. Each sample was individually weighted and adjusted to give a 1:10 dilution (wt/vol) in physiological saline. Each sample was macerated and serially diluted ten fold. Each diluted sample was plated in duplicate on BG agar plates containing 150 ug nalidixic acid. The number of bacteria was enumerated for each sample and the $\log_{10}$ CFU was averaged for each treatment group at each time period.

Figure 8:
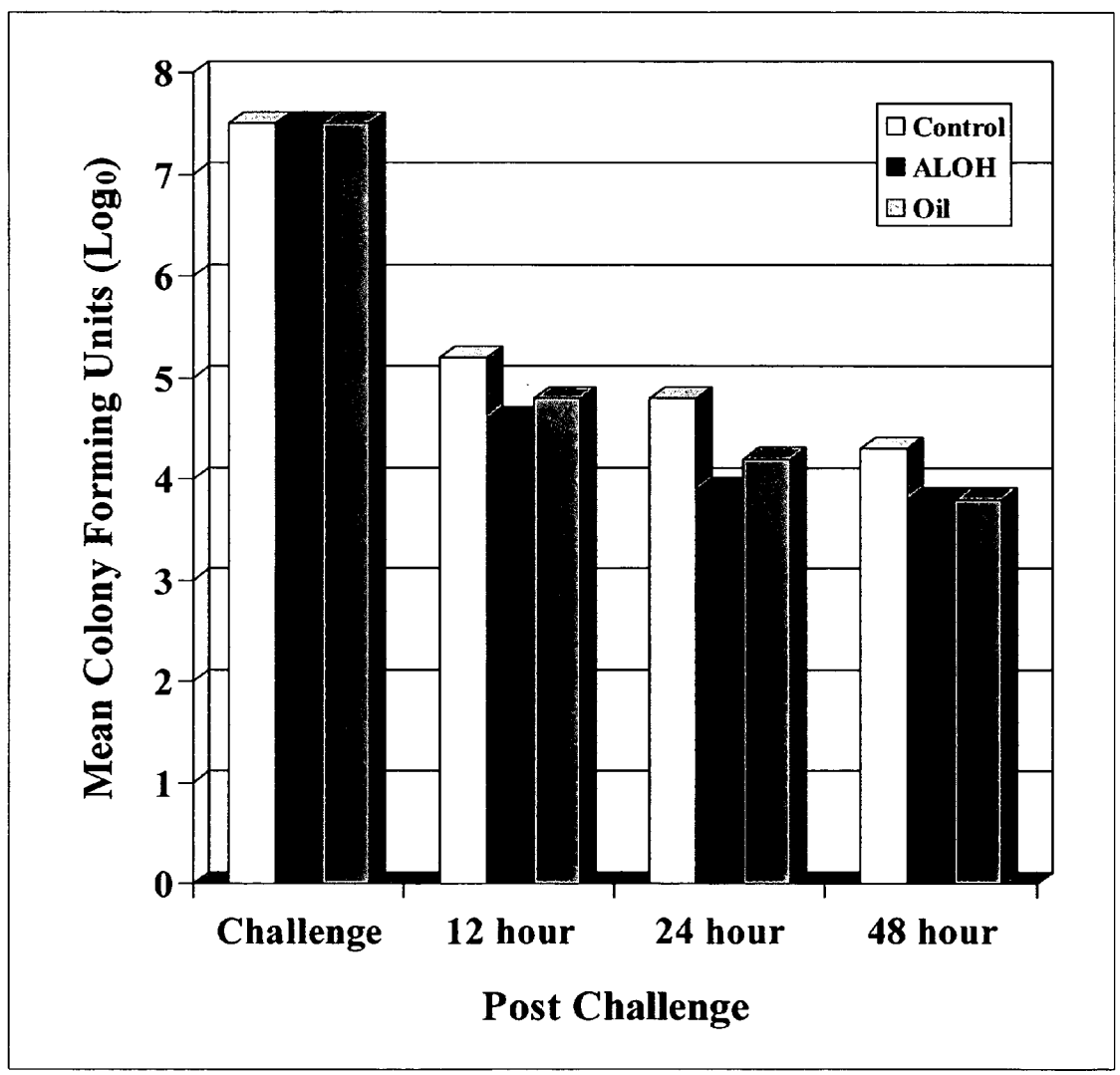
FIG. 8. Clearance of *Salmonella enterica* serovar Enteritidis from the Spleens of Control and Vaccinated Groups following Intravenous Challenge in Chickens.

FIG. 8 shows the quantitative clearance of S. enterica serovar Enteritidis in spleens of vaccinated and non-vaccinated chickens, 12, 24 and 48 hours after challenge. The results show a steady decline in the number of CFU of S. enterica serovar Enteritidis in the vaccinated groups for each treatment group that was statistically significant at each sampling period as compared to the non-vaccinated controls. The aluminum hydroxide vaccinated birds of group $A_1$ compared to the non-vaccinated controls ($C_1$) showed a highly statistical difference at each sampling period (12, 24 and 48 hours post challenge) with degrees of significance of P=0.036, 0.0003 and 0.024 respectively. A similar scenario was observed in birds vaccinated with the oil-emulsified vaccine (group $B_1$) showing statistically significant differences at 24 and 48 hours after challenge have degrees of significance of P=0.00072 and 0.0123, respectively, when compared to the non-vaccinated controls (group $C_1$). There was no significant difference at the 12 hour sampling period due to a large variation in plate counts at this time period.

Figure 9:
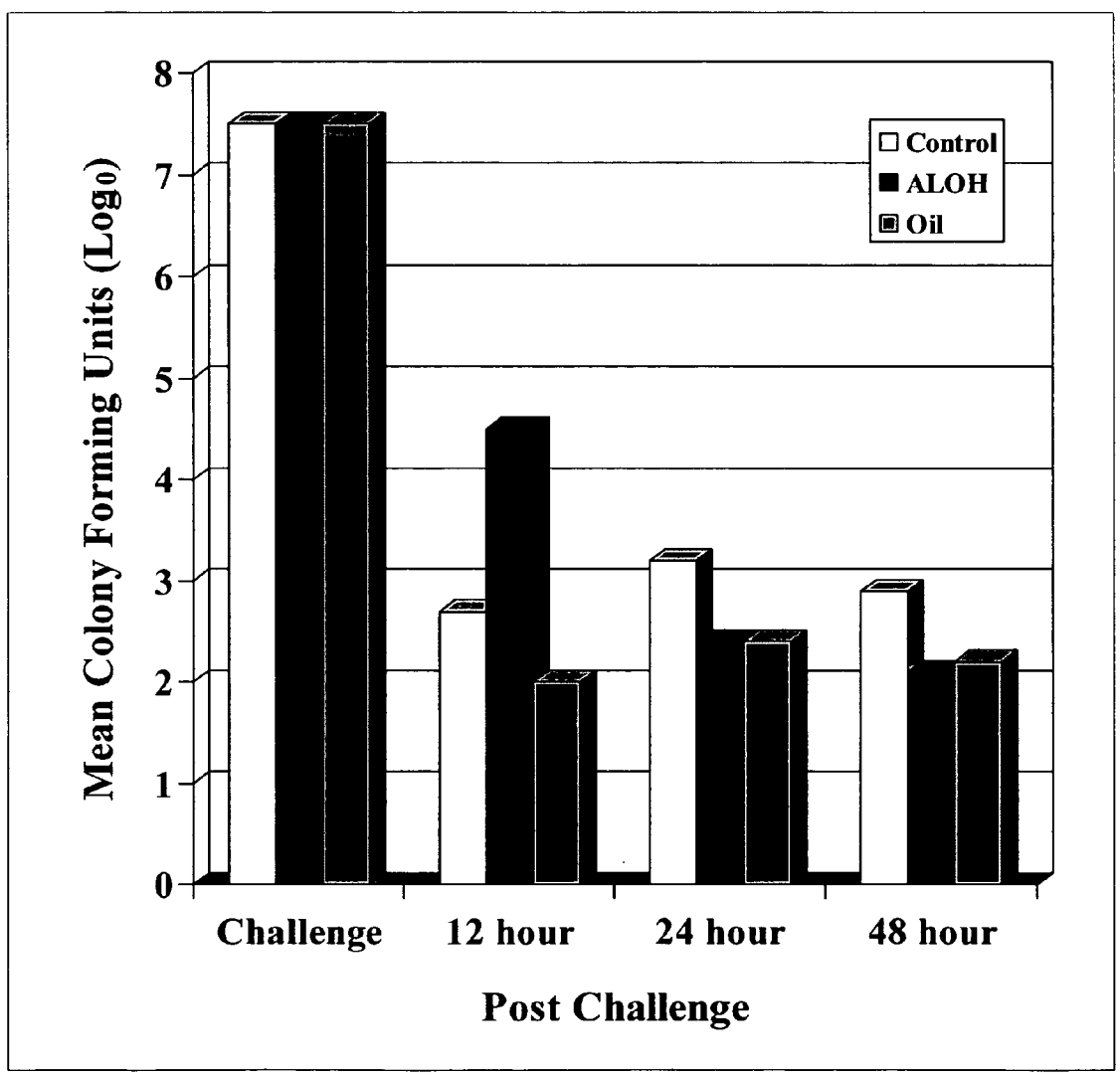
FIG. 9. Clearance of *Salmonella enterica* serovar Enteritidis from the Ovaries of Control and Vaccinated Groups following Intravenous Challenge in Chickens.

FIG. 9 shows the difference in the number of CFU of S. enterica serovar Enteritidis in ovaries between vaccinated and non-vaccinated birds among the different treatment groups. The aluminum hydroxide vaccinated birds of group $A_1$ showed statistical differences at the 24 and 48 hour sampling periods as compared to the non-vaccinated birds of group $C_1$ with degrees of significance of P=0.005 and 0.04 respectively. The oil emulsified vaccinated birds of group $B_1$ also showed degrees of significance at the 24 and 48 hour sampling periods with degrees of significance of P=0.0048 and 0.045. As before, there was no significant difference at the 12 hour sampling period due to variation in plate counts.

Figure 10:
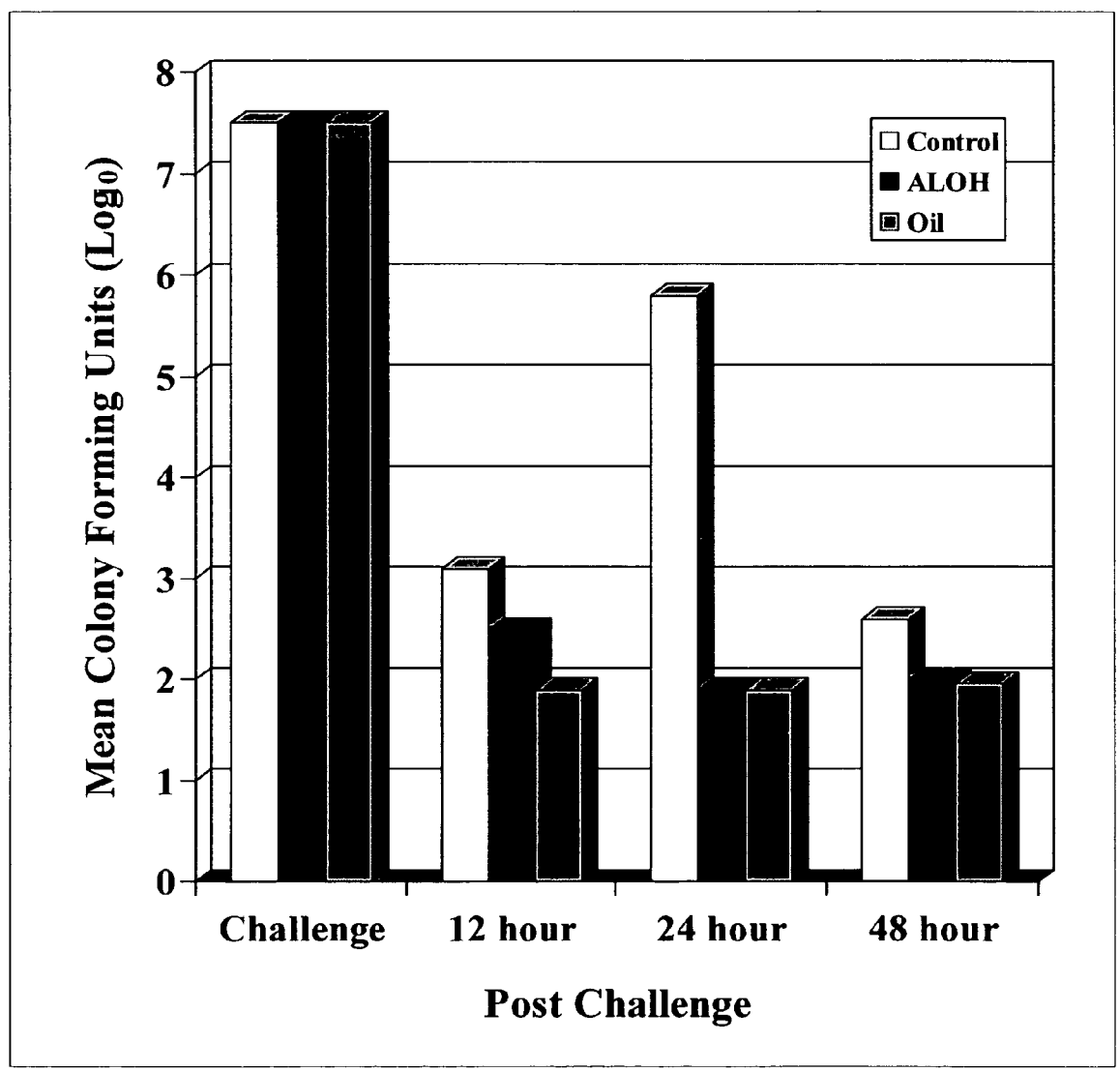
FIG. 10. Difference in Fecal Shedding of *Salmonella enterica* serovar Enteritidis in Control and Vaccinated Groups following Intravenous Challenge in Chickens.

FIG. 10 shows the colonization differences or the fecal shedding of S. enterica serovar Enteritidis in the cecal junction between vaccinated and non-vaccinated control birds. Statistical differences were seen in both treatment groups ($A_1$ and $B_1$) when compared to non-vaccinated controls at the 48 hour only sampling period with degrees of significance of P=0.01 and 0.0096 respectively.

Figure 94:
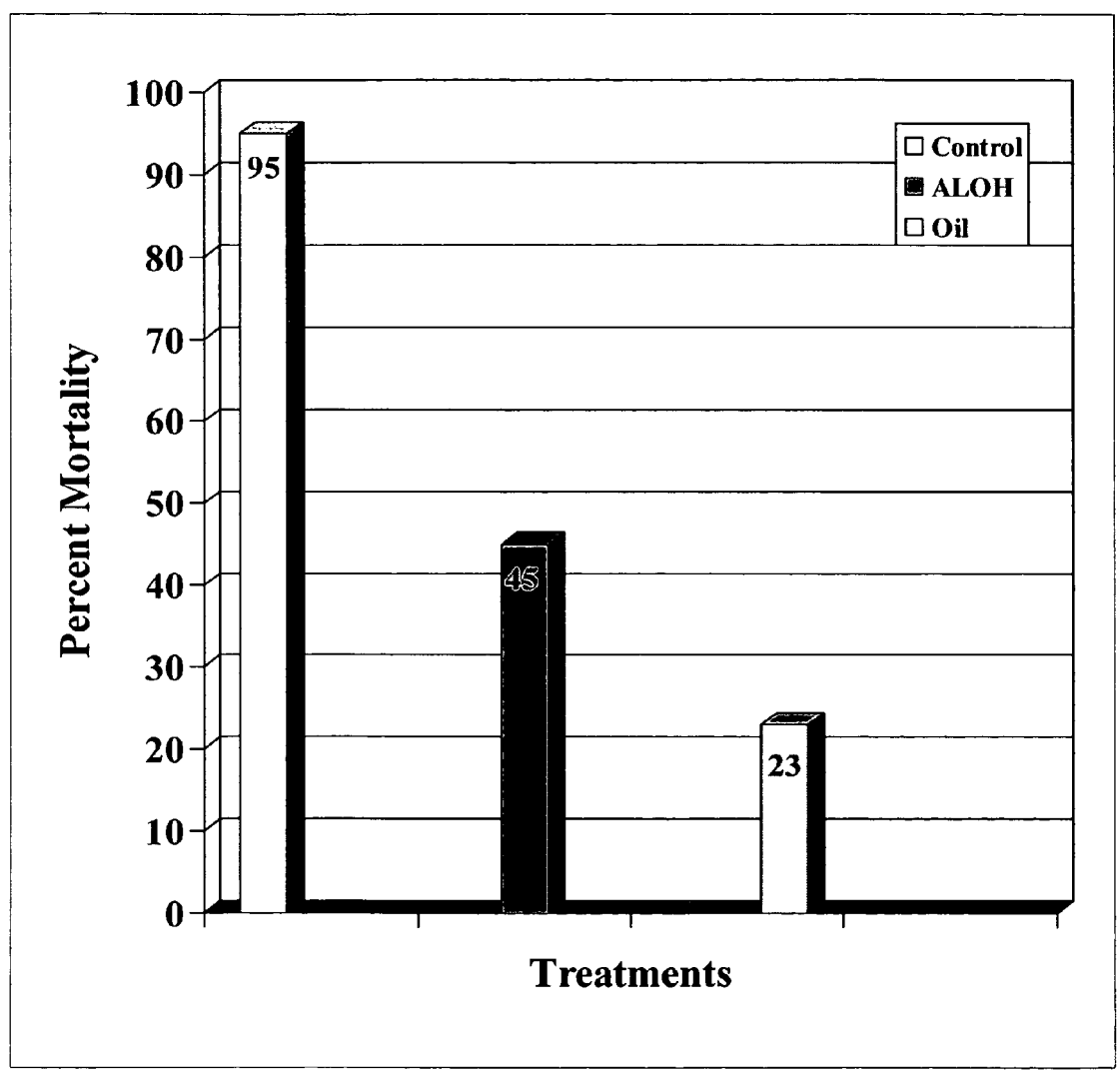
FIG. 94. The difference in mortality between vaccinated and non-vaccinated chickens after intravenous challenge with *S. enterica* serovar Enteritidis.

Birds in Groups $A_2$, $B_2$ and $C_2$ (40 birds/group) were intravenously challenged with the high dose of S. enterica serovar Enteritidis ($3.45 \times 10^9$ CFU/ml) to evaluate the difference in mortality between vaccinated and non-vaccinated treatment groups (table 27). Mortality was recorded at 12 hour intervals for a period of seven 7 days. There was a significant difference in the observed mortality between birds given the aluminum hydroxide ($A_2$) versus the oil-emulsified adjuvanted vaccine ($B_2$) (Table 27). Total 7 day mortality in the aluminum hydroxide ($A_2$) group was 45% compared to 23% in the oil-emulsified groups ($B_2$) and 95% in the non-vaccinated controls of group $C_2$ (FIG. 94). The degree of significance of group $A_2$ compared to the non-vaccinated control group $C_2$ was (p=$5.67 \times 10^{-7}$) while the degree of significance of group $B_2$ compared to $C_2$ was (p=$6.79 \times 10^{-12}$).

TABLE 27

The cumulative mortality between vaccinated treatment groups compared to non-vaccinated controls following intravenous challenge with S. enterica serovar Enteritidis

| Time Post Challenge | Controls (C2) | Oil Emulsion (B2) | Aluminum Hydroxide (A2) |
|---|---|---|---|
| 12 hour | 0 | 0 | 0 |
| 24 hours | 14 | 0 | 0 |
| 36 hours | 3 | 0 | 0 |
| 48 hours | 5 | 0 | 0 |
| 60 hours | 2 | 0 | 0 |
| 72 hours | 7 | 0 | 1 |
| 84 hours | 4 | 0 | 2 |
| 96 hours | 1 | 1 | 1 |
| 108 hours | 1 | 0 | 5 |
| 120 hours | 1 | 1 | 3 |
| 132 hours | 0 | 2 | 1 |
| 144 hours | 0 | 1 | 3 |
| 156 hours | 0 | 3 | 1 |
| 168 hours | 0 | 1 | 1 |
| Total mortality | 38/40 (95%) | 9/40 (23%) | 18/40 (45%) |

The results of this study demonstrate that a vaccine including proteins isolated from S. enterica serovar Enteritidis grown under iron-limiting conditions is protective against subsequent challenge by the pathogen in layer chickens. Birds immunized with the vaccine prepared in two commonly used adjuvants showed a significant reduction in the number of colony forming units of the challenge organism (S. enterica serovar Enteritidis) from internal organs (spleen and ovaries) following intravenous challenge compared to the non-vaccinated controls. In addition, vaccination also reduced the fecal shedding or colonization of S. enterica serovar Enteritidis after challenge as compared to the non-vaccinated controls. Both vaccination regiments used in this study resulted in good protection against an intravenous challenge in chickens. In addition, there was minimal adverse reaction at the site of injection, which is a major advantage of the compositions described herein when compared to commercially available bacterins.

Example 24

Characterization of Metal Regulated Proteins of an S. enterica Serovar Newport Isolate The proteins of the composition prepared as described in Example 1 from the S. enterica serovar Newport strain were characterized using matrix assisted laser desorption/ionization time-of-flight spectrometry (MALDI-TOF MS). A portion of the composition was resolved using a sodium dodecyl sulfate-polyacrylamide gel. After the proteins of a composition had been resolved, the gel stained with either coomasie brilliant blue or silver to visualize the proteins. This method was also used to characterize compositions obtained from S. enterica serovar Enteritidis strain MS010531, S. enterica serovar Typhimurium strain MS010427, and S. enterica serovar IRP SDC Serial.

Materials and Methods

Excision and washing. The gel was washed for 10 minutes with water twice. Each protein band of interest was excised by cutting as close to the protein band as possible to reduce the amount of gel present in the sample. Fourteen gel fragments were prepared, and included polypeptides having the following approximate molecular weights (in kilodaltons): 82 and 79 (excised together in a single gel slice), 74, 65, 56, 55, 45, 38 and 38 (excised together in a single gel slice), 36, 22, 18, and 12.

Each gel slice was cut into 1×1 mm cubes and placed in 1.5 ml tube. The gel pieces were washed with water for 15 minutes. All the solvent volumes used in the wash steps were approximately equal to twice the volume of the gel slice. The gel slice was next washed with water/acetonitrile (1:1) for 15 minutes. When the proteins had been stained with silver, the water/acetonitrile mixture was removed, the gel pieces dried in a SPEEDVAC (ThermoSavant, Holbrook, N.Y.) and then reduced and alkylated as described below. When the gel pieces were not silver-stained, the water/acetonitrile mixture was removed, and acetonitrile was added to cover until the gel pieces turned a sticky white, at which time the acetonitrile was removed. The gel pieces were rehydrated in 100 mM $NH_4HCO_3$, and after 5 minutes, a volume of acetonitrile equal to twice the volume of the gel pieces was added. This was incubated for 15 minutes, the liquid removed, and the gel pieces dried in a SPEEDVAC.

Reduction & alkylation. The dried gel pieces were rehydrated in 10 mM DTT and 100 mM $NH_4HCO_3$, and incubated for 45 minutes at 56° C. After allowing the tubes to cool to room temperature, the liquid was removed and the same volume of a mixture of 55 mM iodoacetamide and 100 mM $NH_4HCO_3$ was immediately added. This was incubated for 30 minutes at room temperature in the dark. The liquid was removed, acetonitrile was added to cover until the gel pieces turned a sticky white, at which time the acetonitrile was removed. The gel pieces were rehydrated in 100 mM $NH_4HCO_3$, and after 5 minutes, a volume of acetonitrile equal to twice the volume of the gel pieces was added. This was incubated for 15 minutes, the liquid removed, and the gel pieces dried in a SPEEDVAC. If the gel was stained with coomasie blue, and residual coomassie still remained, the wash with 100 mM $NH_4HCO_3$/acetonitrile was repeated.

In-gel digestion. Gel pieces were completely dried down in a SPEEDVAC. The pieces were rehydrated in digestion buffer (50 mM $NH_4HCO_3$, 5 mM $CaCl_2$, 12.5 nanograms per microliter (ng/µl) trypsin) at 4° C. Enough buffer was added to cover the gel pieces, and more was added as needed. The gel pieces were incubated on ice for 45 minutes, and the supernatant removed and replaced with 5-2 µl of same buffer without trypsin. This was incubated at 37° C. overnight in an air incubator.

Extraction of peptides. A sufficient volume of 25 mM $NH_4HCO_3$ was added to cover gel pieces, and incubated for 15 minutes (typically in a bath sonicator). The same volume of acetonitrile was added and incubated for 15 minutes (in a bath sonicator if possible), and the supernatant was recovered. The extraction was repeated twice, using 5% formic acid instead of $NH_4HCO_3$. A sufficient volume of 5% formic acid was added to cover gel pieces, and incubated for 15 minutes (typically in a bath sonicator). The same volume of acetonitrile was added and incubated for 15 minutes (typically in a bath sonicator), and the supernatant was recovered. The extracts were pooled, and 10 mM DTT was added to a final concentration of 1 mM DTT. The sample was dried in a SPEEDVAC to a final volume of approximately 5 µl.

Desalting of peptides. The samples were desalted using a ZIPTIP pipette tips (C18, Millipore, Billerica, Mass.) as suggested by the manufacturer. Briefly, a sample was reconstituted in reconstitution solution (5:95 acetonitrile:$H_2O$, 0.1%-0.5% trifluoroacetic acid), centrifuged, and the pH checked to verify that it was less than 3. A ZIPTIP was hydrated by aspirating 10 µl of solution 1 (50:50 acetonitrile:$H_2O$, 0.1% trifluoroacetic acid) and discarding the aspirated aliquots. This was followed by aspirating 10 µl of solution 2 (0.1% trifluoroacetic acid in deionized $H_2O$) and discarding the aspirated aliquots. The sample was loaded into the tip by aspirating 10 µl of the sample slowly into the tip, expelling it into the sample tube, and repeating this 5 to 6 times. Ten microliters of solution 2 was aspirated into the tip, the solution discarded by expelling, and this process was repeated 5-7 times to wash. The peptides were eluted by aspirating 2.5 µl of ice cold solution 3 (60:40, acetonitrile:$H_2O$, 0.1% trofluoroacetic acid), expelling, and then re-aspirating the same aliquot in and out of the tip 3 times. After the solution has been expelled from the tip, the tube is capped and stored on ice.

Mass spectrometric peptide mapping. The peptides were suspended in 10 µl to 30 µl of 5% formic acid, and analyzed by MALDI-TOF MS (Bruker Daltonics Inc., Billerica, Mass.). The mass spectrum of the peptide fragments was determined as suggested by the manufacturer. Briefly, a sample containing the peptides resulting from a tryptic digest were mixed with matrix cyano-4-hydroxycinnamic acid, transferred to a target, and allowed to dry. The dried sample was placed in the mass spectrometer, irradiated, and the time of flight of each ion detected and used to determine a peptide mass fingerprint for each protein present in the composition. Known polypeptides were used to standardize the machine.

Data analysis. The experimentally observed masses for the peptides in each mass spectrum were compared to the expected masses of proteins using the Peptide Mass Fingerprint search method of the MASCOT search engine (Matrix Science Ltd., London, UK, and www.matrixscience.com, see Perkins et al., Electrophoresis 20, 3551-3567 (1999)). The search parameters included: database, NCBInr; taxonomy, bacteria (eubacteria); type of search, peptide mass fingerprint; enzyme, trypsin; fixed modifications, carbamidomethyl (C) or none; variable modifications, oxidation (M), carbamidomethyl (C), the combination, or none; mass values, monoisotopic; protein mass, unrestricted; peptide mass tolerance, between ±100 ppm and ±300 ppm or 450 ppm, or ±1 Da; peptide charge state, Mr; max missed cleavages, 0 or 1; number of queries, 25.

Results

The result of this search was a mass fingerprint for each protein present in the composition (Table 28-31).

TABLE 28

Experimental data from MALDI-TOF MS analysis of *S. enterica* serovar Newport

| Polypeptide Designation | Approximate molecular weight in kilodaltons (kDa)[1] | m/z value of polypeptide fragments resulting from trypsin digestion[2] |
|---|---|---|
| Lw221 (±300 ppm) | 82 | 629.5 |
| | | 644.5 |
| | | 772.5 |
| | | 831.5 |
| | | 873.5 |
| | | 991.6 |
| | | 1083.6 |
| | | 1208.6 |
| | | 1325.8 |
| | | 1378.7 |
| | | 1464.8 |
| | | 1500.7 |
| | | 1516.7 |
| | | 1619.9 |
| | | 1634.9 |
| | | 1635.9 |
| | | 1728.9 |

TABLE 28-continued

Experimental data from MALDI-TOF MS analysis of S. enterica serovar Newport

| Polypeptide Designation | Approximate molecular weight in kilodaltons (kDa)[1] | m/z value of polypeptide fragments resulting from trypsin digestion[2] |
|---|---|---|
|  |  | 1873.1 |
|  |  | 1982.1 |
|  |  | 1998.2 |
|  |  | 2014.1 |
|  |  | 2194.1 |
|  |  | 2332.3 |
| Lw223A (±300 ppm) | 80 | 849.5 |
|  |  | 919.5 |
|  |  | 1041.7 |
|  |  | 1098.7 |
|  |  | 1310.7 |
|  |  | 1336.8 |
|  |  | 1342.7 |
|  |  | 1365.7 |
|  |  | 1529.8 |
|  |  | 1565.9 |
|  |  | 1737.1 |
|  |  | 1752.0 |
|  |  | 1756.1 |
|  |  | 1847.2 |
|  |  | 1913.2 |
|  |  | 1930.2 |
|  |  | 1936.3 |
|  |  | 2032.3 |
|  |  | 2417.5 |
|  |  | 2588.6 |
|  |  | 2702.9 |
|  |  | 2910.8 |
|  |  | 2945.0 |
| Lw223B (±300 ppm) | 74 | 606.5 |
|  |  | 617.5 |
|  |  | 809.5 |
|  |  | 1064.5 |
|  |  | 1159.6 |
|  |  | 1211.6 |
|  |  | 1315.7 |
|  |  | 1330.8 |
|  |  | 1346.7 |
|  |  | 1528.0 |
|  |  | 1651.1 |
|  |  | 1679.0 |
|  |  | 1742.1 |
|  |  | 1745.9 |
|  |  | 1752.0 |
|  |  | 1794.1 |
|  |  | 1816.1 |
|  |  | 1908.2 |
|  |  | 1936.3 |
|  |  | 1954.2 |
|  |  | 1988.2 |
|  |  | 2243.4 |
|  |  | 2539.6 |
|  |  | 2588.6 |
|  |  | 2711.6 |
| P4 (±300 ppm) | 65 | 1304.60 |
|  |  | 1399.55 |
|  |  | 1509.71 |
|  |  | 1793.82 |
|  |  | 1869.90 |
|  |  | 1933.90 |
|  |  | 2024.94 |
|  |  | 2087.08 |
|  |  | 2258.20 |
| Lw224 (±300 ppm) | 56 | 1101.6 |
|  |  | 1132.8 |
|  |  | 1255.9 |
|  |  | 1717.1 |
|  |  | 1758.2 |
|  |  | 1960.2 |
|  |  | 2035.4 |
|  |  | 2670.8 |
|  |  | 2805.8 |
|  |  | 2861.1 |
|  |  | 3061.1 |
| Lw225 (±300 ppm) | 55 | 959.6 |
|  |  | 1101.6 |
|  |  | 1132.7 |
|  |  | 1144.7 |
|  |  | 1255.8 |
|  |  | 1605.0 |
|  |  | 1615.0 |
|  |  | 1623.1 |
|  |  | 1641.0 |
|  |  | 1710.0 |
|  |  | 1717.0 |
|  |  | 1772.2 |
|  |  | 1905.2 |
|  |  | 1960.2 |
|  |  | 2085.4 |
|  |  | 2196.4 |
|  |  | 2670.7 |
|  |  | 2805.7 |
|  |  | 3060.9 |
| Lw226 (±300 ppm) | 52 | 788.5 |
|  |  | 800.5 |
|  |  | 802.5 |
|  |  | 828.5 |
|  |  | 914.6 |
|  |  | 1090.5 |
|  |  | 1286.7 |
|  |  | 1382.8 |
|  |  | 1550.8 |
|  |  | 1616.9 |
|  |  | 1663.0 |
|  |  | 1739.0 |
|  |  | 1830.0 |
|  |  | 2035.1 |
|  |  | 2185.3 |
|  |  | 2209.3 |
|  |  | 2227.2 |
|  |  | 2685.6 |
|  |  | 2749.6 |
|  |  | 2887.6 |
| Lw227 (±300 ppm) | 45 | 666.5 |
|  |  | 731.5 |
|  |  | 813.5 |
|  |  | 859.5 |
|  |  | 964.5 |
|  |  | 1151.5 |
|  |  | 1224.6 |
|  |  | 1412.7 |
|  |  | 1423.8 |
|  |  | 1659.9 |
|  |  | 1685.0 |
|  |  | 1781.9 |
|  |  | 1966.2 |
|  |  | 2087.3 |
|  |  | 2183.2 |
|  |  | 2297.4 |
|  |  | 3101.7 |
|  |  | 3315.9 |
| Lw228A (±300 ppm) | 38 | 719.6 |
|  |  | 868.5 |
|  |  | 1058.6 |
|  |  | 1104.5 |
|  |  | 1122.6 |
|  |  | 1297.6 |
|  |  | 1639.9 |
|  |  | 2219.3 |
|  |  | 2383.2 |
|  |  | 2390.2 |
|  |  | 2604.4 |

TABLE 28-continued

Experimental data from MALDI-TOF MS analysis of S. enterica serovar Newport

| Polypeptide Designation | Approximate molecular weight in kilodaltons (kDa)[1] | m/z value of polypeptide fragments resulting from trypsin digestion[2] |
|---|---|---|
|  |  | 2717.4 |
|  |  | 2758.5 |
|  |  | 2806.6 |
|  |  | 2835.5 |
|  |  | 3066.6 |
|  |  | 3451.7 |
| Lw228B (±300 ppm) | 38 | 705.6 |
|  |  | 794.5 |
|  |  | 901.5 |
|  |  | 909.6 |
|  |  | 1106.6 |
|  |  | 1205.6 |
|  |  | 1801.9 |
|  |  | 1835.9 |
|  |  | 1946.1 |
|  |  | 1987.0 |
|  |  | 2248.3 |
|  |  | 2383.2 |
|  |  | 3005.7 |
|  |  | 3134.7 |
| Lw230A (±300 ppm) | 36 | 818.5 |
|  |  | 872.6 |
|  |  | 915.5 |
|  |  | 1025.5 |
|  |  | 1083.6 |
|  |  | 1157.6 |
|  |  | 1264.6 |
|  |  | 1378.7 |
|  |  | 1381.6 |
|  |  | 1537.7 |
|  |  | 1640.8 |
|  |  | 2303.3 |
|  |  | 2616.3 |
|  |  | 2673.4 |
|  |  | 3423.9 |
| Lw233 (±300 ppm) | 22 | 1051.7 |
|  |  | 1222.7 |
|  |  | 1588.9 |
|  |  | 1736.0 |
|  |  | 1821.1 |
|  |  | 2738.6 |
|  |  | 2853.7 |
|  |  | 3220.9 |
| Lw234 (±300 ppm) | 18 | 796.4 |
|  |  | 1263.6 |
|  |  | 1416.6 |
|  |  | 1479.7 |
|  |  | 1626.8 |
|  |  | 1797.9 |
|  |  | 2176.0 |
|  |  | 2447.1 |
|  |  | 2495.1 |
| Lw235 (±300 ppm) | 12 | 789.5 |
|  |  | 1246.6 |
|  |  | 1258.6 |
|  |  | 1361.7 |
|  |  | 1531.9 |
|  |  | 2061.1 |
|  |  | 2874.6 |

[1]Molecular weight, in kilodaltons, of polypeptide obtained from S. enterica serovar Newport.
[2]m/z, mass (m) to charge (z) ratio. Each m/z value includes a range of plus or minus 300 ppm.

TABLE 29

Experimental data from MALDI-TOF MS analysis of S. enterica serovar Enteritidis

| Polypeptide Designation | Approximate molecular weight in kilodaltons (kDa)[1] | m/z value of polypeptide fragments resulting from trypsin digestion[2] |
|---|---|---|
| Lw98 (±1 Da) | 92 | 729.61 |
|  |  | 816.54 |
|  |  | 889.51 |
|  |  | 958.56 |
|  |  | 973.62 |
|  |  | 987.62 |
|  |  | 999.54 |
|  |  | 1009.56 |
|  |  | 1048.62 |
|  |  | 1077.64 |
|  |  | 1114.61 |
|  |  | 1181.55 |
|  |  | 1220.62 |
|  |  | 1277.56 |
|  |  | 1283.77 |
|  |  | 1339.65 |
|  |  | 1385.61 |
|  |  | 1402.70 |
|  |  | 1403.69 |
|  |  | 1471.70 |
|  |  | 1520.84 |
|  |  | 1528.74 |
|  |  | 1649.80 |
|  |  | 1692.96 |
|  |  | 1713.93 |
|  |  | 1733.89 |
|  |  | 1759.91 |
|  |  | 1787.97 |
|  |  | 1895.03 |
|  |  | 1955.01 |
|  |  | 2160.25 |
|  |  | 2255.09 |
|  |  | 2286.19 |
|  |  | 2794.68 |
|  |  | 2882.59 |
| Lw99 (±1 Da) | 91 | 905.48 |
|  |  | 925.41 |
|  |  | 946.49 |
|  |  | 1005.46 |
|  |  | 1051.45 |
|  |  | 1077.49 |
|  |  | 1110.47 |
|  |  | 1200.52 |
|  |  | 1277.51 |
|  |  | 1295.47 |
|  |  | 1308.60 |
|  |  | 1344.52 |
|  |  | 1376.58 |
|  |  | 1418.64 |
|  |  | 1451.54 |
|  |  | 1510.49 |
|  |  | 1511.63 |
|  |  | 1602.79 |
|  |  | 1619.68 |
|  |  | 1625.71 |
|  |  | 1669.65 |
|  |  | 1767.85 |
|  |  | 1768.86 |
|  |  | 1793.81 |
|  |  | 1809.83 |
|  |  | 1833.85 |
|  |  | 2014.04 |
|  |  | 2089.13 |
|  |  | 2269.98 |
|  |  | 2299.06 |
|  |  | 2454.09 |
|  |  | 2255.19 |
|  |  | 2573.21 |

TABLE 29-continued

Experimental data from MALDI-TOF MS analysis of S. enterica serovar Enteritidis

| Polypeptide Designation | Approximate molecular weight in kilodaltons (kDa)[1] | m/z value of polypeptide fragments resulting from trypsin digestion[2] |
|---|---|---|
| Lw101 (±1 Da) | 86 | 644.6 |
| | | 873.5 |
| | | 951.5 |
| | | 991.5 |
| | | 1083.6 |
| | | 1085.5 |
| | | 1096.4 |
| | | 1152.6 |
| | | 1182.4 |
| | | 1208.5 |
| | | 1325.6 |
| | | 1366.5 |
| | | 1378.5 |
| | | 1412.6 |
| | | 1433.6 |
| | | 1464.6 |
| | | 1500.5 |
| | | 1561.7 |
| | | 1562.7 |
| | | 1585.6 |
| | | 1619.6 |
| | | 1634.7 |
| | | 1728.7 |
| | | 1871.8 |
| | | 1904.9 |
| | | 1975.9 |
| | | 1981.9 |
| | | 1998.0 |
| | | 2078.9 |
| | | 2193.0 |
| | | 2234.1 |
| | | 2372.0 |
| | | 2532.2 |
| | | 2623.3 |
| | | 2634.1 |
| | | 3099.3 |
| | | 3212.4 |
| | | 3474.5 |
| Lw102 (±1 Da) | 83 | 611.5 |
| | | 629.6 |
| | | 849.4 |
| | | 919.4 |
| | | 1041.5 |
| | | 1098.5 |
| | | 1142.4 |
| | | 1154.5 |
| | | 1163.4 |
| | | 1219.5 |
| | | 1310.4 |
| | | 1336.5 |
| | | 1342.5 |
| | | 1365.4 |
| | | 1406.6 |
| | | 1461.6 |
| | | 1529.5 |
| | | 1565.6 |
| | | 1736.7 |
| | | 1752.7 |
| | | 1755.7 |
| | | 1846.8 |
| | | 1881.9 |
| | | 1912.9 |
| | | 1954.9 |
| | | 2031.9 |
| | | 2262.0 |
| | | 2399.0 |
| | | 2417.1 |
| | | 2702.3 |
| | | 2910.4 |
| | | 2944.5 |
| Lw103 (±1 Da) | 78 | 606.5 |
| | | 615.6 |
| | | 617.6 |
| | | 809.4 |
| | | 837.4 |
| | | 990.4 |
| | | 1061.4 |
| | | 1064.4 |
| | | 1142.4 |
| | | 1159.4 |
| | | 1178.5 |
| | | 1211.4 |
| | | 1315.5 |
| | | 1330.6 |
| | | 1346.4 |
| | | 1494.6 |
| | | 1527.6 |
| | | 1571.7 |
| | | 1650.8 |
| | | 1655.8 |
| | | 1741.8 |
| | | 1745.6 |
| | | 1751.8 |
| | | 1793.9 |
| | | 1815.8 |
| | | 1907.9 |
| | | 1953.9 |
| | | 2243.1 |
| | | 5239.4 |
| | | 2711.3 |
| Lw104 (±1 Da) | 55 | 788.5 |
| | | 802.5 |
| | | 914.6 |
| | | 1180.5 |
| | | 1227.5 |
| | | 1286.5 |
| | | 1382.6 |
| | | 1550.7 |
| | | 1616.8 |
| | | 1662.8 |
| | | 1738.8 |
| | | 1829.9 |
| | | 2035.0 |
| | | 2185.1 |
| | | 2209.0 |
| | | 2227.1 |
| | | 2749.3 |
| | | 2887.5 |
| Lw106A (±1 Da) | 40 | 692.5 |
| | | 705.6 |
| | | 901.5 |
| | | 909.6 |
| | | 974.5 |
| | | 1106.6 |
| | | 1129.4 |
| | | 1192.5 |
| | | 1205.5 |
| | | 1439.6 |
| | | 1801.9 |
| | | 1891.9 |
| | | 1991.0 |
| | | 2248.2 |
| | | 2340.3 |
| | | 2406.2 |
| | | 3005.7 |
| Lw106B (±1 Da) | 39 | 719.6 |
| | | 868.5 |
| | | 1058.5 |
| | | 1104.5 |
| | | 1122.5 |
| | | 1280.5 |

TABLE 29-continued

Experimental data from MALDI-TOF MS analysis of *S. enterica* serovar Enteritidis

| Polypeptide Designation | Approximate molecular weight in kilodaltons (kDa)[1] | m/z value of polypeptide fragments resulting from trypsin digestion[2] |
|---|---|---|
| | | 1297.5 |
| | | 1640.8 |
| | | 1891.9 |
| | | 2219.2 |
| | | 2383.2 |
| | | 2390.2 |
| | | 2758.5 |
| | | 2806.6 |
| | | 3067.6 |
| Lw108 (±1 Da) | 38 | 818.5 |
| | | 1025.5 |
| | | 1083.6 |
| | | 1222.7 |
| | | 1233.6 |
| | | 1264.7 |
| | | 1378.8 |
| | | 1381.7 |
| | | 1470.8 |
| | | 1537.9 |
| | | 1641.0 |
| | | 2303.5 |
| | | 2616.7 |
| | | 2673.8 |
| | | 3424.3 |

[1]Molecular weight, in kilodaltons, of polypeptide obtained from *S. enterica* serovar Enteritidis.
[2]m/z, mass (m) to charge (z) ratio. Each m/z value includes a range of plus or minus 1 Dalton.

TABLE 30

Experimental data from MALDI-TOF MS analysis of *S. enterica* serovar Typhimurium

| Polypeptide Designation | Approximate molecular weight in kilodaltons (kDa)[1] | m/z value of polypeptide fragments resulting from trypsin digestion[2] |
|---|---|---|
| Lw111 (±1 Da) | 86 | 991.6 |
| | | 1083.7 |
| | | 1182.6 |
| | | 1208.6 |
| | | 1307.7 |
| | | 1325.8 |
| | | 1378.7 |
| | | 1433.8 |
| | | 1478.8 |
| | | 1500.8 |
| | | 1585.8 |
| | | 1618.9 |
| | | 1619.9 |
| | | 1634.9 |
| | | 1659.9 |
| | | 1729.0 |
| | | 1872.1 |
| | | 1982.1 |
| | | 1998.2 |
| | | 2022.2 |
| | | 2079.2 |
| | | 2119.4 |
| | | 2194.2 |
| | | 2204.2 |
| | | 2332.3 |
| | | 2374.3 |
| | | 2633.5 |
| | | 3099.9 |
| Lw112 (±1 Da) | 82 | 611.5 |
| | | 849.5 |
| | | 919.5 |
| | | 1041.6 |
| | | 1095.6 |
| | | 1098.6 |
| | | 1154.7 |
| | | 1163.6 |
| | | 1209.6 |
| | | 1219.7 |
| | | 1310.7 |
| | | 1336.7 |
| | | 1342.7 |
| | | 1365.7 |
| | | 1406.8 |
| | | 1529.8 |
| | | 1565.9 |
| | | 1566.9 |
| | | 1737.0 |
| | | 1756.0 |
| | | 1847.1 |
| | | 1882.2 |
| | | 1884.1 |
| | | 1913.2 |
| | | 1931.2 |
| | | 1955.2 |
| | | 2032.2 |
| | | 2192.4 |
| | | 2262.3 |
| | | 2417.4 |
| | | 2449.4 |
| | | 2702.2 |
| | | 2910.7 |
| | | 2944.9 |
| Lw113 (±1 Da) | 77 | 958.5 |
| | | 1159.5 |
| | | 1179.5 |
| | | 1211.5 |
| | | 1309.7 |
| | | 1315.6 |
| | | 1330.7 |
| | | 1346.5 |
| | | 1398.7 |
| | | 1527.7 |
| | | 1650.9 |
| | | 1655.9 |
| | | 1745.7 |
| | | 1751.9 |
| | | 1793.7 |
| | | 1954.0 |
| | | 2022.1 |
| | | 2202.1 |
| | | 2243.1 |
| Lw115A (±1 Da) | 40 | 652.6 |
| | | 705.7 |
| | | 794.6 |
| | | 901.6 |
| | | 909.6 |
| | | 1106.7 |
| | | 1120.6 |
| | | 1129.5 |
| | | 1175.6 |
| | | 1205.5 |
| | | 1348.8 |
| | | 1439.8 |
| | | 1802.0 |
| | | 1835.9 |
| | | 1987.1 |
| | | 2248.1 |
| | | 2340.2 |
| | | 2406.1 |

TABLE 30-continued

Experimental data from MALDI-TOF MS analysis of S. enterica serovar Typhimurium

| Polypeptide Designation | Approximate molecular weight in kilodaltons (kDa)[1] | m/z value of polypeptide fragments resulting from trypsin digestion[2] |
|---|---|---|
|  |  | 3005.6 |
|  |  | 3134.5 |
| Lw115B (±1 Da) | 39 | 719.7 |
|  |  | 868.6 |
|  |  | 1058.7 |
|  |  | 1104.6 |
|  |  | 1122.7 |
|  |  | 1161.6 |
|  |  | 1280.7 |
|  |  | 1297.5 |
|  |  | 2219.1 |
|  |  | 2383.1 |
|  |  | 2390.1 |
|  |  | 2758.3 |
|  |  | 2806.4 |
|  |  | 3451.5 |
| Lw117 (±1 Da) | 38 | 645.6 |
|  |  | 818.5 |
|  |  | 872.6 |
|  |  | 915.6 |
|  |  | 943.5 |
|  |  | 1025.5 |
|  |  | 1043.6 |
|  |  | 1083.5 |
|  |  | 1141.6 |
|  |  | 1222.6 |
|  |  | 1264.6 |
|  |  | 1378.7 |
|  |  | 1381.6 |
|  |  | 1470.6 |
|  |  | 1537.7 |
|  |  | 1640.7 |
|  |  | 1709.8 |
|  |  | 2303.2 |
|  |  | 2616.3 |
|  |  | 2627.2 |
|  |  | 2673.4 |
|  |  | 3423.7 |
|  |  | 3540.8 |

[1]Molecular weight, in kilodaltons, of polypeptide obtained from S. enterica serovar Typhimurium.
[2]m/z, mass (m) to charge (z) ratio. Each m/z value includes a range of plus or minus 1 Dalton.

TABLE 31

Experimental data from MALDI-TOF MS analysis of S. enterica serovar Dublin.

| Polypeptide Designation | Approximate molecular weight in kilodaltons (kDa)[1] | m/z value of polypeptide fragments resulting from trypsin digestion[2] |
|---|---|---|
| Dublin-1 (±300 ppm) | 96 | 1083.43 |
|  |  | 1208.36 |
|  |  | 1315.32 |
|  |  | 1378.40 |
|  |  | 1500.50 |
|  |  | 1516.48 |
|  |  | 1634.65 |
|  |  | 1728.66 |
|  |  | 1871.78 |
|  |  | 1956.88 |
|  |  | 1981.83 |
|  |  | 1997.93 |
|  |  | 2013.92 |
|  |  | 2119.03 |
|  |  | 2193.82 |
|  |  | 2203.84 |
|  |  | 2209.82 |
|  |  | 2331.9 |
| Dublin-2 (±1 Da) | 89 | 611.32 |
|  |  | 629.38 |
|  |  | 849.27 |
|  |  | 919.23 |
|  |  | 1041.34 |
|  |  | 1098.34 |
|  |  | 1219.28 |
|  |  | 1310.27 |
|  |  | 1336.36 |
|  |  | 1342.31 |
|  |  | 1365.25 |
|  |  | 1529.35 |
|  |  | 1565.39 |
|  |  | 1736.52 |
|  |  | 1752.52 |
|  |  | 1846.58 |
|  |  | 1881.64 |
|  |  | 1912.69 |
|  |  | 2262.75 |
|  |  | 2416.81 |
|  |  | 2702.01 |
|  |  | 2910.99 |
| Dublin-3 (±1 Da) | 81 | 606.31 |
|  |  | 617.37 |
|  |  | 990.19 |
|  |  | 1064.17 |
|  |  | 1178.19 |
|  |  | 1315.21 |
|  |  | 1330.34 |
|  |  | 1527.30 |
|  |  | 1650.36 |
|  |  | 1741.45 |
|  |  | 1745.26 |
|  |  | 1751.39 |
|  |  | 1793.44 |
|  |  | 1815.42 |
|  |  | 1907.47 |
|  |  | 1936.49 |
|  |  | 1953.31 |
|  |  | 2196.69 |
|  |  | 2242.57 |
|  |  | 2552.77 |
|  |  | 2587.73 |
|  |  | 2710.65 |
| Dublin-4 (±1 Da) | 61 | 632.32 |
|  |  | 945.20 |
|  |  | 1101.13 |
|  |  | 1116.16 |
|  |  | 1164.15 |
|  |  | 1317.16 |
|  |  | 1475.24 |
|  |  | 1764.30 |
|  |  | 1833.30 |
|  |  | 2007.47 |
|  |  | 2084.57 |
|  |  | 2669.63 |
|  |  | 2683.59 |
|  |  | 2859.91 |
| Dublin-5 (±1 Da) | 56 | 914.20 |
|  |  | 989.18 |
|  |  | 1286.12 |
|  |  | 1382.20 |
|  |  | 1550.21 |
|  |  | 1616.31 |
|  |  | 1662.31 |
|  |  | 1738.31 |
|  |  | 1829.32 |

TABLE 31-continued

Experimental data from MALDI-TOF MS analysis of S. enterica serovar Dublin.

| Polypeptide Designation | Approximate molecular weight in kilodaltons (kDa)[1] | m/z value of polypeptide fragments resulting from trypsin digestion[2] |
|---|---|---|
| | | 2034.37 |
| | | 2185.46 |
| | | 2208.44 |
| Dublin-6 (±1 Da) | 51 | 945.18 |
| | | 1116.13 |
| | | 1221.10 |
| | | 1317.12 |
| | | 1445.06 |
| | | 1475.17 |
| | | 1815.31 |
| | | 1833.26 |
| | | 2007.39 |
| | | 2669.52 |
| | | 2683.47 |
| | | 2859.77 |
| Dublin-7 (±450 ppm) | 43 | 1172.16 |
| | | 1188.14 |
| | | 1343.12 |
| | | 1376.05 |
| | | 1392.04 |
| | | 1423.19 |
| | | 1527.29 |
| | | 1854.31 |
| | | 2344.42 |
| | | 2360.41 |
| | | 3078.65 |
| Dublin-8 (±1 Da) | 40 | 1205.09 |
| | | 1348.22 |
| | | 1439.14 |
| | | 1802.27 |
| | | 1836.26 |
| | | 2247.49 |
| | | 2339.52 |
| | | 2405.42 |
| | | 3004.81 |
| Dublin-9, 10, 11 (±1 Da) | 38 | 818.24 |
| | | 1025.36 |
| | | 1083.42 |
| | | 1264.26 |
| | | 1378.64 |
| | | 1381.53 |
| | | 1640.41 |
| | | 2302.91 |
| | | 2615.82 |
| | | 2672.85 |
| | | 3423.18 |

[1]Molecular weight, in kilodaltons, of polypeptide obtained from S. enterica serovar Dublin.
[2]m/z, mass (m) to charge (z) ratio. Each m/z value includes a range of plus or minus 300 ppm (the polypeptide Dublin-1), 450 ppm (the polypeptide Dublin-7), or 1 Dalton (the remaining polypeptides).

Example 25

Characterization of Metal Regulated Proteins of E. coli

The proteins of the composition prepared as described in Example 1 from the E. coli strain BEcO157(stx−) were characterized using MALDI-TOF MS as described in Example 24. Twelve gel fragments were prepared, and included polypeptides having the following approximate molecular weights (in kilodaltons): 90, 86, 83, 79, a doublet at 66, 56, 38, 37, and 29. These methods were also used for the characterization of proteins of the E. coli strains MS040330, MS040324, and MS040827.

Results

The result of this search was a mass fingerprint for each protein present in the composition (Table 32-35).

TABLE 32

Experimental data from MALDI-TOF MS analysis of E. coli strain BEcO157(stx-).

| Polypeptide Designation | Approximate molecular weight in kilodaltons (kDa)[1] | m/z value of polypeptide fragments resulting from trypsin digestion[2] |
|---|---|---|
| Lw118 (±1 Da) | 90 | 629.7 |
| | | 772.6 |
| | | 831.5 |
| | | 991.6 |
| | | 1178.6 |
| | | 1285.6 |
| | | 1321.7 |
| | | 1369.7 |
| | | 1433.8 |
| | | 1516.8 |
| | | 1619.9 |
| | | 1634.9 |
| | | 1706.9 |
| | | 1788.0 |
| | | 1798.0 |
| | | 1872.1 |
| | | 1966.2 |
| | | 1982.1 |
| | | 2089.1 |
| | | 2175.1 |
| | | 2303.2 |
| | | 2601.5 |
| | | 2706.6 |
| | | 2844.6 |
| | | 3082.8 |
| | | 3213.8 |
| Lw119 (±1 Da) | 86 | 976.5 |
| | | 992.6 |
| | | 1095.5 |
| | | 1247.6 |
| | | 1278.7 |
| | | 1359.7 |
| | | 1396.5 |
| | | 1436.7 |
| | | 1493.6 |
| | | 1572.9 |
| | | 1650.8 |
| | | 1665.8 |
| | | 1810.9 |
| | | 1914.0 |
| | | 2134.3 |
| | | 2211.2 |
| | | 2270.1 |
| LW-1A-3 (±300 ppm) | 83 | 837.27 |
| | | 884.29 |
| | | 1048.20 |
| | | 1127.26 |
| | | 1338.26 |
| | | 1351.29 |
| | | 1397.26 |
| | | 1472.33 |
| | | 1621.46 |
| | | 1650.47 |
| | | 1722.49 |
| | | 1727.41 |
| | | 1759.47 |
| | | 1813.46 |
| | | 1829.43 |
| | | 2282.75 |
| | | 2512.79 |
| Lw121 (±1 Da) | 79 | 716.5 |
| | | 952.5 |
| | | 1135.5 |
| | | 1155.7 |
| | | 122.6 |
| | | 1336.6 |
| | | 1396.6 |
| | | 1447.7 |
| | | 1512.7 |
| | | 1532.7 |
| | | 1653.8 |

TABLE 32-continued

Experimental data from MALDI-TOF MS analysis of *E. coli* strain BEcO157(stx-).

| Polypeptide Designation | Approximate molecular weight in kilodaltons (kDa)[1] | m/z value of polypeptide fragments resulting from trypsin digestion[2] |
|---|---|---|
|  |  | 1657.8 |
|  |  | 1677.9 |
|  |  | 1717.9 |
|  |  | 1780.0 |
|  |  | 1861.0 |
|  |  | 1964.1 |
|  |  | 2262.2 |
|  |  | 2398.2 |
| LW-1A-5A (±450 ppm) | 66 | 632.33 |
|  |  | 945.20 |
|  |  | 1191.31 |
|  |  | 1238.16 |
|  |  | 1440.25 |
|  |  | 1561.26 |
|  |  | 1647.24 |
|  |  | 1792.36 |
|  |  | 2062.63 |
|  |  | 2085.55 |
|  |  | 2190.41 |
|  |  | 2248.51 |
|  |  | 2454.66 |
|  |  | 2628.63 |
| LW-1A-5B (±450 ppm) | 66 | 679.45 |
|  |  | 1295.14 |
|  |  | 1299.04 |
|  |  | 1304.17 |
|  |  | 1423.20 |
|  |  | 1550.34 |
|  |  | 1820.33 |
|  |  | 1892.48 |
|  |  | 1918.33 |
|  |  | 2159.57 |
|  |  | 2323.52 |
|  |  | 2357.55 |
|  |  | 2699.58 |
| LW-1A-6 (±450 ppm) | 56 | 1285.15 |
|  |  | 1395.19 |
|  |  | 1550.25 |
|  |  | 1616.35 |
|  |  | 1829.34 |
|  |  | 2034.42 |
|  |  | 2139.53 |
|  |  | 2183.52 |
|  |  | 2242.47 |
| Lw123 (±1 Da) | 38 | 705.5 |
|  |  | 885.4 |
|  |  | 931.5 |
|  |  | 939.4 |
|  |  | 1120.4 |
|  |  | 1122.5 |
|  |  | 1124.4 |
|  |  | 1171.4 |
|  |  | 1290.4 |
|  |  | 1348.5 |
|  |  | 1379.4 |
|  |  | 1380.5 |
|  |  | 1439.5 |
|  |  | 1664.6 |
|  |  | 1820.7 |
|  |  | 1821.7 |
|  |  | 2232.9 |
|  |  | 2353.9 |
|  |  | 2447.9 |
|  |  | 2585.1 |
|  |  | 2792.1 |
|  |  | 2991.3 |
|  |  | 3106.3 |
| Lw124 (±1 Da) | 37 | 818.4 |
|  |  | 915.4 |
|  |  | 1027.5 |
|  |  | 1055.3 |
|  |  | 1083.4 |
|  |  | 1155.4 |
|  |  | 1222.5 |
|  |  | 1280.4 |
|  |  | 1378.5 |
|  |  | 1409.4 |
|  |  | 1443.5 |
|  |  | 1565.5 |
|  |  | 1654.6 |
|  |  | 1709.7 |
|  |  | 2231.9 |
|  |  | 2600.1 |
|  |  | 2601.0 |
|  |  | 2671.0 |
|  |  | 3478.4 |
| LW-1A-10 (±300 ppm) | 29 | 951.32 |
|  |  | 1020.31 |
|  |  | 1485.37 |
|  |  | 1501.36 |
|  |  | 1517.50 |
|  |  | 1676.54 |
|  |  | 1692.47 |

[1] Molecular weight, in kilodaltons, of polypeptide obtained from *E. coli* strain BEcO157 (stx-).
[2] m/z, mass (m) to charge (z) ratio. Each m/z value includes a range of plus or minus 300 ppm (the 83 kDa and 29 kDa polypeptides), 450 ppm (the 66 kDa and 56 kDa polypeptides), or 1 Dalton (the remaining polypeptide).

TABLE 33

Experimental data from MALDI-TOF MS analysis of *E. coli* strain MS040330.

| Polypeptide Designation | Approximate molecular weight in kilodaltons (kDa)[1] | m/z value of polypeptide fragments resulting from trypsin digestion[2] |
|---|---|---|
| AB1-1 (±250 ppm) | 92 | 905.38 |
|  |  | 909.28 |
|  |  | 1051.29 |
|  |  | 1079.32 |
|  |  | 1172.32 |
|  |  | 1277.26 |
|  |  | 1344.32 |
|  |  | 1404.39 |
|  |  | 1467.34 |
|  |  | 1480.42 |
|  |  | 1511.37 |
|  |  | 1547.30 |
|  |  | 1568.40 |
|  |  | 1625.45 |
|  |  | 1641.44 |
|  |  | 1669.39 |
|  |  | 1685.37 |
|  |  | 1740.54 |
|  |  | 1823.54 |
|  |  | 1859.56 |
|  |  | 2122.66 |
|  |  | 2140.64 |
| AB1-2 (±300 ppm) | 80 | 629.56 |
|  |  | 831.31 |
|  |  | 1178.28 |
|  |  | 1634.37 |
|  |  | 1787.37 |

TABLE 33-continued

Experimental data from MALDI-TOF MS analysis of *E. coli* strain MS040330.

| Polypeptide Designation | Approximate molecular weight in kilodaltons (kDa)[1] | m/z value of polypeptide fragments resulting from trypsin digestion[2] |
|---|---|---|
| | | 1787.37 |
| | | 1797.30 |
| | | 1871.47 |
| | | 1981.45 |
| | | 2088.38 |
| | | 2091.59 |
| | | 2174.41 |
| | | 2303.43 |
| | | 2843.60 |
| AB1-3 (±400 ppm) | 77 | 1381.12 |
| | | 1526.19 |
| | | 1689.32 |
| | | 1750.32 |
| | | 1832.33 |
| | | 1889.45 |
| | | 1929.36 |
| | | 1968.43 |
| | | 1984.43 |
| | | 2031.32 |
| | | 2918.52 |
| | | 2959.75 |
| AB1-4 (±400 ppm) | 72 | 629.51 |
| | | 808.24 |
| | | 872.25 |
| | | 889.19 |
| | | 1739.11 |
| | | 1763.14 |
| | | 1873.25 |
| | | 1999.31 |
| | | 2104.23 |
| | | 2141.27 |
| | | 2207.32 |
| | | 2415.36 |
| | | 2439.43 |
| AB1-5 (±500 ppm) | 66 | 615.37 |
| | | 716.27 |
| | | 771.26 |
| | | 831.08 |
| | | 942.06 |
| | | 952.10 |
| | | 1026.17 |
| | | 1150.99 |
| | | 1155.12 |
| | | 1222.04 |
| | | 1335.99 |
| | | 1395.96 |
| | | 1531.96 |
| | | 1657.93 |
| | | 1673.00 |
| | | 1677.03 |
| | | 1717.11 |
| | | 1779.09 |
| | | 1963.12 |
| | | 1998.11 |
| | | 2261.12 |
| | | 2397.12 |
| | | 3305.10 |
| AB1-6 (±450 ppm) | 50 | 788.24 |
| | | 802.23 |
| | | 828.20 |
| | | 914.20 |
| | | 1180.04 |
| | | 1345.96 |
| | | 1737.18 |
| | | 1829.11 |
| | | 2035.14 |
| | | 2184.22 |
| | | 2185.23 |
| | | 2227.19 |
| AB1-7 (±400 ppm) | 42 | 632.41 |
| | | 709.30 |
| | | 716.31 |
| | | 760.25 |
| | | 931.16 |
| | | 1003.12 |
| | | 1020.15 |
| | | 2248.21 |
| | | 2642.26 |
| | | 2700.21 |
| | | 2815.45 |
| AB1-8 (±500 ppm) | 38 | 705.30 |
| | | 842.18 |
| | | 885.07 |
| | | 1289.95 |
| | | 1439.00 |
| | | 2553.13 |
| | | 2990.28 |
| AB1-9 (±450 ppm) | 36 | 719.37 |
| | | 868.16 |
| | | 1058.17 |
| | | 1249.01 |
| | | 1439.07 |
| | | 1934.06 |
| | | 2217.24 |
| | | 2389.19 |
| | | 2834.32 |
| AB1-10 (±400 ppm) | 35 | 818.29 |
| | | 834.28 |
| | | 872.28 |
| | | 1055.16 |
| | | 1280.19 |
| | | 1378.26 |
| | | 1423.20 |
| | | 1640.26 |
| | | 2231.49 |
| | | 2599.58 |
| | | 3495.73 |
| AB1-11 (±300 ppm) | 30 | 707.41 |
| | | 777.48 |
| | | 930.38 |
| | | 965.44 |
| | | 1066.41 |
| | | 1082.38 |
| | | 1109.37 |
| | | 1205.37 |
| | | 1221.32 |
| | | 1404.52 |
| | | 1577.47 |
| | | 1592.47 |
| | | 2392.78 |
| Lw214 (±1 Da) | 19 | 915.8 |
| | | 942.7 |
| | | 951.8 |
| | | 1020.9 |
| | | 1486.2 |
| | | 1518.3 |
| | | 1605.2 |
| | | 1677.4 |
| | | 1679.3 |
| Lw215 (±1 Da) | 16 | 603.5 |
| | | 915.6 |
| | | 942.5 |
| | | 951.6 |
| | | 1020.6 |
| | | 1043.7 |
| | | 1148.7 |
| | | 1363.7 |
| | | 1485.8 |
| | | 1518.0 |
| | | 1604.9 |

TABLE 33-continued

Experimental data from MALDI-TOF MS analysis of *E. coli* strain MS040330.

| Polypeptide Designation | Approximate molecular weight in kilodaltons (kDa)[1] | m/z value of polypeptide fragments resulting from trypsin digestion[2] |
|---|---|---|
| | | 1677.0 |
| | | 1769.0 |
| | | 1933.1 |
| | | 2263.3 |

[1]Molecular weight, in kilodaltons, of polypeptide obtained from *E. coli* strain MS040330.
[2]m/z, mass (m) to charge (z) ratio. Each m/z value includes a range of plus or minus 250 ppm (the 92 kDa polypeptide), plus or minus 300 ppm (the 80 kDa and 30 kDa polypeptides), plus or minus 400 ppm (the 77 kDa, 72 kDa, 42 kDa, and 35 kDa polypeptides), plus or minus 450 ppm (the 50 kDa and 36 kDa polypeptides), plus or minus 500 ppm (the 66 kDa and 38 kDa polypeptides) or 1 Dalton (the 19 kDa and 16 kDa polypeptides).

TABLE 34

Experimental data from MALDI-TOF MS analysis of *E. coli* strain MS040324.

| Polypeptide Designation | Approximate molecular weight in kilodaltons (kDa)[1] | m/z value of polypeptide fragments resulting from trypsin digestion[2] |
|---|---|---|
| J4-1 (±400 ppm) | 82 | 629.46 |
| | | 1307.21 |
| | | 1532.22 |
| | | 1579.33 |
| | | 1634.33 |
| | | 1787.34 |
| | | 1797.32 |
| | | 1981.42 |
| | | 2089.41 |
| | | 2091.56 |
| | | 2126.48 |
| | | 2843.61 |
| J4-2 (±300 ppm) | 79 | 686.54 |
| | | 737.44 |
| | | 842.49 |
| | | 861.44 |
| | | 1147.48 |
| | | 1163.44 |
| | | 1208.43 |
| | | 1244.42 |
| | | 1279.62 |
| | | 1473.59 |
| | | 1487.60 |
| | | 1579.67 |
| | | 1616.67 |
| | | 1718.71 |
| | | 2014.87 |
| | | 2036.81 |
| | | 2110.97 |
| | | 2126.95 |
| J4-3 (±300 ppm) | 88 | 650.52 |
| | | 672.53 |
| | | 821.37 |
| | | 1124.32 |
| | | 1279.50 |
| | | 1297.39 |
| | | 1325.37 |
| | | 1381.37 |
| | | 1424.43 |
| | | 1551.45 |
| | | 1703.56 |
| | | 1732.51 |
| | | 2024.70 |
| | | 2036.67 |
| | | 2251.76 |
| | | 2787.11 |
| | | 2847.98 |
| J4-4 (±300 ppm) | 60 | 676.37 |
| | | 679.52 |
| | | 1756.36 |
| | | 1820.39 |
| | | 1892.53 |
| | | 1932.42 |
| | | 2024.43 |
| | | 2159.65 |
| | | 2207.56 |
| | | 2255.71 |
| | | 2323.60 |
| | | 2357.64 |
| | | 2699.70 |
| J4-5 (±400 ppm) | 54 | 788.28 |
| | | 802.28 |
| | | 828.24 |
| | | 914.26 |
| | | 1231.12 |
| | | 1285.15 |
| | | 1323.25 |
| | | 1346.10 |
| | | 1550.24 |
| | | 1616.31 |
| | | 1737.36 |
| | | 1829.31 |
| | | 2034.39 |
| | | 2139.50 |
| | | 2183.47 |
| | | 2242.46 |
| J4-6 (±350 ppm) | 46 | 731.33 |
| | | 859.24 |
| | | 964.18 |
| | | 1563.21 |
| | | 1579.20 |
| | | 1677.22 |
| | | 1684.35 |
| | | 1731.31 |
| | | 2132.45 |
| | | 2148.46 |
| | | 2210.46 |
| | | 2371.41 |
| | | 2387.42 |
| | | 3216.50 |
| J4-7 (±400 ppm) | 45 | 786.26 |
| | | 1025.13 |
| | | 1030.16 |
| | | 1255.15 |
| | | 1497.14 |
| | | 1505.19 |
| | | 1587.22 |
| | | 1652.17 |
| | | 1794.25 |
| | | 1899.36 |
| | | 1998.32 |
| Lw216 (±300 ppm) | 38 | 868.5 |
| | | 1249.7 |
| | | 1439.8 |
| | | 1935.1 |
| | | 2218.4 |
| | | 2390.4 |
| | | 2602.6 |
| | | 2977.6 |
| | | 3308.1 |
| Lw217 (±1 Da) | 37 | 818.4 |
| | | 1280.6 |
| | | 1378.7 |
| | | 2232.2 |
| | | 2600.5 |
| | | 2602.4 |

TABLE 34-continued

Experimental data from MALDI-TOF MS analysis of *E. coli* strain MS040324.

| Polypeptide Designation | Approximate molecular weight in kilodaltons (kDa)[1] | m/z value of polypeptide fragments resulting from trypsin digestion[2] |
|---|---|---|
| J4-11 (±300 ppm) | 31 | 707.35 |
| | | 777.40 |
| | | 930.33 |
| | | 965.35 |
| | | 1066.31 |
| | | 1082.29 |
| | | 1109.27 |
| | | 1205.26 |
| | | 1221.24 |
| | | 1404.42 |
| | | 1576.39 |
| | | 1576.39 |
| | | 1592.38 |
| | | 2392.69 |
| J4-12 (±400 ppm) | 30 | 717.33 |
| | | 1339.16 |
| | | 1463.13 |
| | | 1841.21 |
| | | 1857.18 |
| | | 1882.30 |
| | | 1898.31 |
| | | 2263.24 |
| | | 2825.38 |
| | | 2868.54 |
| Lw218 (±1 Da) | 19 | 915.6 |
| | | 942.5 |
| | | 951.6 |
| | | 1020.6 |
| | | 1363.7 |
| | | 1485.8 |
| | | 1518.0 |
| | | 1604.9 |
| | | 1677.0 |
| | | 1679.0 |
| | | 1756.1 |
| | | 1933.2 |
| | | 2263.4 |
| Lw219 (±1 Da) | 16 | 603.3 |
| | | 915.5 |
| | | 942.4 |
| | | 951.5 |
| | | 1020.5 |
| | | 1043.6 |
| | | 1148.6 |
| | | 1363.5 |
| | | 1485.6 |
| | | 1517.8 |
| | | 1604.8 |
| | | 1676.8 |
| | | 1755.9 |
| | | 1768.9 |
| | | 1932.9 |
| | | 2263.1 |

[1]Molecular weight, in kilodaltons, of polypeptide obtained from *E. coli* strain MS040324.

[2]m/z, mass (m) to charge (z) ratio. Each m/z value includes a range of plus or minus 300 ppm (the 88 kDa, 79 kDa, 60 kDa, 38 kDa, and 31 kDa polypeptides), plus or minus 350 ppm (the 46 kDa polypeptide), plus or minus 400 ppm (the 82 kDa, 54 kDa, 45 kDa, and 30 kDa polypeptides), or plus or minus 1 Dalton (the 37 kDa, 19 kDa and 16 kDa polypeptides).

TABLE 35

Experimental data from MALDI-TOF MS analysis of *E. coli* strain MS040827.

| Polypeptide Designation | Approximate molecular weight in kilodaltons (kDa)[1] | m/z value of polypeptide fragments resulting from trypsin digestion[2] |
|---|---|---|
| Lw189A (±300 ppm) | 101 | 889.38 |
| | | 987.47 |
| | | 999.42 |
| | | 1009.40 |
| | | 1114.54 |
| | | 1277.56 |
| | | 1339.61 |
| | | 1402.67 |
| | | 1471.65 |
| | | 1520.80 |
| | | 1528.76 |
| | | 1699.95 |
| | | 1759.95 |
| | | 1771.84 |
| | | 1955.01 |
| | | 2146.22 |
| | | 2156.16 |
| | | 2239.30 |
| | | 2255.14 |
| | | 2912.67 |
| Lw189B (±300 ppm) | 101 | 905.46 |
| | | 1172.53 |
| | | 1277.56 |
| | | 1295.50 |
| | | 1308.56 |
| | | 1344.62 |
| | | 1404.72 |
| | | 1451.67 |
| | | 1547.72 |
| | | 1669.78 |
| | | 1718.76 |
| | | 1764.93 |
| | | 1823.94 |
| | | 1833.02 |
| | | 1860.08 |
| | | 2014.15 |
| | | 2089.24 |
| Lw190 (±1 Da) | 88 | 1178.44 |
| | | 1307.50 |
| | | 1517.55 |
| | | 1579.72 |
| | | 1634.75 |
| | | 1787.82 |
| | | 1797.76 |
| | | 1871.89 |
| | | 1981.92 |
| | | 2127.06 |
| | | 2174.98 |
| | | 2303.05 |
| | | 2707.40 |
| | | 2844.30 |
| | | 3082.43 |
| | | 3197.45 |
| Lw191 (±1 Da) | 85 | 565.45 |
| | | 686.41 |
| | | 737.43 |
| | | 861.47 |
| | | 862.47 |
| | | 1147.52 |
| | | 1208.53 |
| | | 1244.54 |
| | | 1279.54 |
| | | 1280.52 |
| | | 1330.57 |
| | | 1487.72 |
| | | 1579.76 |
| | | 1616.78 |
| | | 1651.80 |
| | | 1697.79 |
| | | 1718.84 |
| | | 2014.99 |

TABLE 35-continued

Experimental data from MALDI-TOF MS analysis of E. coli strain MS040827.

| Polypeptide Designation | Approximate molecular weight in kilodaltons (kDa)[1] | m/z value of polypeptide fragments resulting from trypsin digestion[2] |
|---|---|---|
|  |  | 2036.95 |
|  |  | 2111.03 |
|  |  | 2222.12 |
|  |  | 2409.18 |
|  |  | 2582.31 |
|  |  | 2684.41 |
|  |  | 2947.43 |
|  |  | 3022.60 |
|  |  | 3145.50 |
| Lw193 (±1 Da) | 77 | 524.21 |
|  |  | 650.30 |
|  |  | 821.32 |
|  |  | 1124.35 |
|  |  | 1160.35 |
|  |  | 1279.56 |
|  |  | 1297.44 |
|  |  | 1325.41 |
|  |  | 1373.52 |
|  |  | 1381.40 |
|  |  | 1424.49 |
|  |  | 1510.59 |
|  |  | 1551.48 |
|  |  | 1554.63 |
|  |  | 1650.61 |
|  |  | 1703.67 |
|  |  | 1924.87 |
|  |  | 2013.84 |
|  |  | 2024.77 |
|  |  | 2204.93 |
|  |  | 2251.87 |
|  |  | 2553.03 |
|  |  | 2786.14 |
|  |  | 2848.01 |
|  |  | 3195.23 |
|  |  | 3337.27 |
|  |  | 3386.31 |
| Lw194 (±1 Da) | 67 | 679.56 |
|  |  | 1113.58 |
|  |  | 1136.53 |
|  |  | 1244.65 |
|  |  | 1260.59 |
|  |  | 1295.59 |
|  |  | 1299.46 |
|  |  | 1304.58 |
|  |  | 1350.56 |
|  |  | 1423.69 |
|  |  | 1522.66 |
|  |  | 1550.84 |
|  |  | 1756.84 |
|  |  | 1762.81 |
|  |  | 1887.91 |
|  |  | 1893.05 |
|  |  | 1932.95 |
|  |  | 2025.00 |
|  |  | 2159.25 |
|  |  | 2207.14 |
|  |  | 2256.18 |
|  |  | 2324.18 |
| Lw195 (±150 ppm) | 38 | 1058.57 |
|  |  | 1249.50 |
|  |  | 1439.66 |
|  |  | 1934.81 |
|  |  | 1960.97 |
|  |  | 2218.06 |
|  |  | 2390.13 |
|  |  | 2977.49 |
|  |  | 3357.61 |
|  |  | 3550.53 |
| Lw196 (±1 Da) | 35 | 645.43 |
|  |  | 818.41 |
|  |  | 834.41 |
|  |  | 872.52 |
|  |  | 915.47 |
|  |  | 1055.45 |
|  |  | 1083.47 |
|  |  | 1155.48 |
|  |  | 1214.51 |
|  |  | 1222.57 |
|  |  | 1249.47 |
|  |  | 1280.55 |
|  |  | 1370.65 |
|  |  | 1378.65 |
|  |  | 1409.55 |
|  |  | 1654.76 |
|  |  | 2062.93 |
|  |  | 2078.94 |
|  |  | 2232.10 |
|  |  | 2601.21 |
|  |  | 3494.61 |

[1] Molecular weight, in kilodaltons, of polypeptide obtained from E. coli strain MS040827.
[2] m/z, mass (m) to charge (z) ratio. Each m/z value includes a range of plus or minus 150 ppm (the 38 kDa and 35 kDa polypeptide), plus or minus 300 ppm (the 101 kDa polypeptides), or plus or minus 1 Dalton (the 88 kDa, 85 kDa, 77 kDa, and 67 kDa polypeptides).

Example 26

Figure 11:
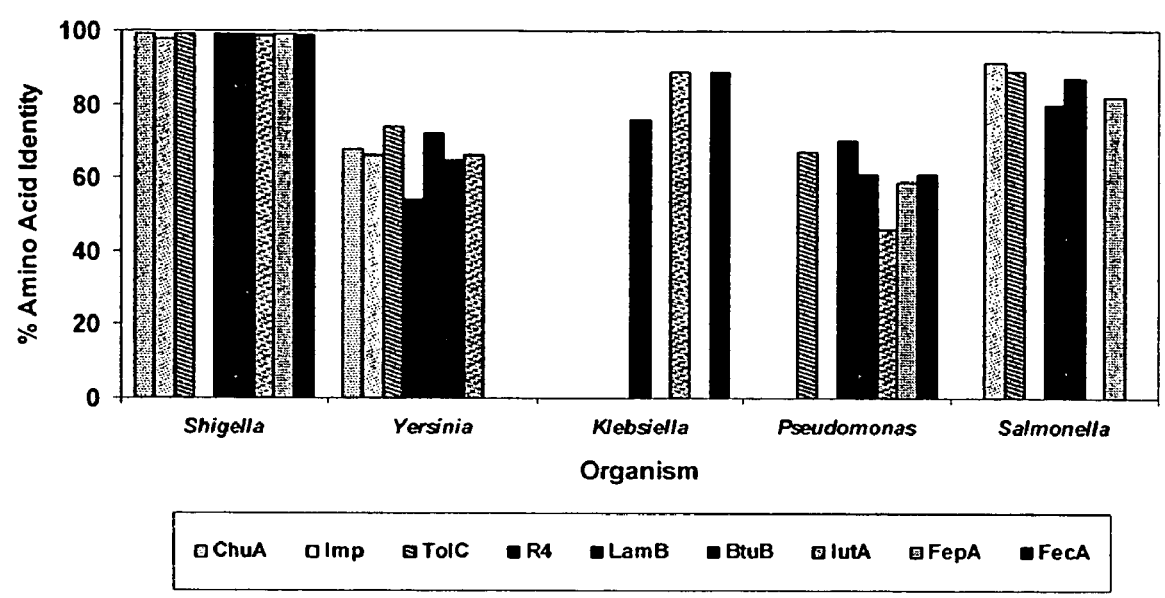
FIG. 11. Comparison of selected proteins identified using *E. coli* grown under iron-limiting conditions with proteins from other pathogens.

Comparison of Proteins Similar to those Expressed by E. coli with Other Proteins The proteins derived from E. coli and Salmonella grown under iron-limiting conditions were identified by MALDI-TOF MS. These analyses resulted in protein sequences that represent the best protein match for each peptide mass fingerprint (see Tables 10-17). The public availability of genomic sequence data allows for a database search for these proteins in other organisms. Thus, nine of the proteins (ChuA, Imp, TolC, R4, LamB, BtuB, IutA, FepA, and FecA) identified from the E. coli strains were used in BLAST searches to determine which other pathogens may also express these proteins. Eight of the ten selected proteins were very similar to proteins from Shigella spp., with 98 to 99% identity at the amino acid level (FIG. 11). Several of the E. coli proteins were also similar to proteins from Salmonella, Yersinia, Klebsiella, and Pseudomonas spp. These analyses suggest that compositions derived from E. coli grown under iron-limiting conditions may constitute antigens that will protect against other pathogens, particularly Shigella species.

The complete disclosure of all patents, patent applications, publications, and electronically available material (including, for instance, nucleotide sequence submissions in, e.g., GenBank and RefSeq, and amino acid sequence submissions in, e.g., SwissProt, PIR, PRF, PDB, and translations from annotated coding regions in GenBank and RefSeq) cited herein are incorporated by reference. The foregoing detailed description and examples have been given for clarity of understanding only. No unnecessary limitations are to be understood therefrom. The invention is not limited to the exact details shown and described, for variations obvious to one skilled in the art will be included within the invention defined by the claims.

All headings are for the convenience of the reader and should not be used to limit the meaning of the text that follows the heading, unless so specified.

SEQUENCE LISTING (1448 sequences)

SEQ ID NO: 1 - protein, 5 aa, Salmonella enterica
IEVLR

SEQ ID NO: 2 - protein, 5 aa, Salmonella enterica
QIDIR

SEQ ID NO: 3 - protein, 7 aa, Salmonella enterica
DINGVVR

SEQ ID NO: 4 - protein, 7 aa, Salmonella enterica
DVSEIIR

SEQ ID NO: 5 - protein, 7 aa, Salmonella enterica
LGWRGER

SEQ ID NO: 6 - protein, 8 aa, Salmonella enterica
EIGLEFKR

SEQ ID NO: 7 - protein, 10 aa, Salmonella enterica
IEAGTVPLQR

SEQ ID NO: 8 - protein, 12 aa, Salmonella enterica
TGSYADTLPAGR

SEQ ID NO: 9 - protein, 12 aa, Salmonella enterica
NKIEAGTVPLQR

SEQ ID NO: 10 - protein, 11 aa, Salmonella enterica
TDVYQWENVPK

SEQ ID NO: 11 - protein, 13 aa, Salmonella enterica
GDTAWVPPEMIER

SEQ ID NO: 12 - protein, 20 aa, Escherichia coli
IANLFDKDYETVYGYQTAGR

SEQ ID NO: 13 - protein, 16 aa, Salmonella enterica
TMPGVNLTGNSTSGQR

SEQ ID NO: 14 - protein, 15 aa, Salmonella enterica
NVSLTGGVDNLFDKR

SEQ ID NO: 15 - protein, 13 aa, Salmonella enterica
LYGNLDKTQADAR

SEQ ID NO: 16 - protein, 16 aa, Salmonella enterica
TNFSLNGPLGGDFSFR

SEQ ID NO: 17 - protein, 16 aa, Salmonella enterica
DTRGDTAWVPPEMIER

SEQ ID NO: 18 - protein, 17 aa, Salmonella enterica
WDFAPLQSLELEAGYSR

SEQ ID NO: 19 - protein, 19 aa, Salmonella enterica
GMGPENTLILIDGKPVTSR

SEQ ID NO: 20 - protein, 10 aa, Escherichia coli
NAEVWAAGLK

SEQ ID NO: 21 - protein, 21 aa, Salmonella enterica
DTQTGAYMAGAGAYTYNEPGR

SEQ ID NO: 22 - protein, 20 aa, Salmonella enterica
KGGSEWHGSWNTYFNAPEHK

SEQ ID NO: 23 - protein, 7 aa, Salmonella enterica
LYGNLNR

SEQ ID NO: 24 - protein, 7 aa, Salmonella enterica
LGFYYEK

SEQ ID NO: 25 - protein, 10 aa, Salmonella enterica
IVAGDQIIGR

SEQ ID NO: 26 - protein, 10 aa, Salmonella enterica
QQPGVSIITR

SEQ ID NO: 27 - protein, 11 aa, Salmonella enterica
ITNDQTFTTNR

SEQ ID NO: 28 - protein, 12 aa, Salmonella enterica
NPPVNDLADIIR

SEQ ID NO: 29 - protein, 14 aa, Salmonella enterica
DSNIAGIPGSAANR

SEQ ID NO: 30 - protein, 13 aa, Salmonella enterica
SAEGANTYNEPGR

SEQ ID NO: 31 - protein, 13 aa, Salmonella enterica
GDTNWVPPEMVER

SEQ ID NO: 32 - protein, 15 aa, Salmonella enterica
SASGAYVLQWQNGGK

SEQ ID NO: 33 - protein, 17 aa, Salmonella enterica
GNFSLSGPLAGDTLTMR

SEQ ID NO: 34 - protein, 15 aa, Salmonella enterica
EGVTNKDINSVFSWR

SEQ ID NO: 35 - protein, 15 aa, Salmonella enterica
MTPQQILDFEAGYSR

SEQ ID NO: 36 - protein, 16 aa, Salmonella enterica
APNLYQTSEGYLLYSK

SEQ ID NO: 37 - protein, 18 aa, Salmonella enterica
ALIEGIEASMAVPLMPDR

SEQ ID NO: 38 - protein, 21 aa, Salmonella enterica
GPAAARYGSGAAGGVVNIITK

SEQ ID NO: 39 - protein, 17 aa, Salmonella enterica
DDIQKNPPVNDLADIIR

SEQ ID NO: 40 - protein, 17 aa, Salmonella enterica
QNYGLTHNGIWDWGQSR

SEQ ID NO: 41 - protein, 21 aa, Salmonella enterica
RPTNDWHGSLSLYTNQPESSK

SEQ ID NO: 42 - protein, 25 aa, Salmonella enterica
IVAGDQIIGRSASGAYVLQWQNGGK

SEQ ID NO: 43 - protein, 25 aa, Salmonella enterica
SEISALYVEDNIEPMAGTNIIPGLR

SEQ ID NO: 44 - protein, 26 aa, Salmonella enterica
FDYLSESGSNFSPSLNLSQELGEYVK

SEQ ID NO: 45 - protein, 27 aa, Salmonella enterica
NKSEISALYVEDNIEPMAGTNIIPGLR

SEQ ID NO: 46 - protein, 5 aa, Salmonella enterica
NAVFR

SEQ ID NO: 47 - protein, 5 aa, Salmonella enterica
VPVFR

SEQ ID NO: 48 - protein, 7 aa, Salmonella enterica
IEGFTSR

SEQ ID NO: 49 - protein, 8 aa, Salmonella enterica
YFMAVDYR

SEQ ID NO: 50 - protein, 10 aa, Salmonella enterica
QNYALSHNGR

SEQ ID NO: 51 - protein, 9 aa, Salmonella enterica
YFMAVDYRF

SEQ ID NO: 52 - protein, 11 aa, Salmonella enterica
LSLNYTYNDGR

SEQ ID NO: 53 - protein, 12 aa, Salmonella enterica
IFEPLALTTGIR

SEQ ID NO: 54 - protein, 11 aa, Salmonella enterica
DDYGYTEDGRR

SEQ ID NO: 55 - protein, 14 aa, Salmonella enterica
EVPGVQLTNEGDNR

SEQ ID NO: 56 - protein, 15 aa, Salmonella enterica
GLDSSYTLILIDGKR

SEQ ID NO: 57 - protein, 16 aa, Salmonella enterica
DEQQSSATTATGETPR

SEQ ID NO: 58 - protein, 16 aa, Salmonella enterica
DAPASISVITQQDLQR

SEQ ID NO: 59 - protein, 14 aa, Salmonella enterica
MDDHETYGDHWSPR

SEQ ID NO: 60 - protein, 15 aa, Salmonella enterica
WHGSVTVDSTIQEHR

SEQ ID NO: 61 - protein, 17 aa, Salmonella enterica
GEEGILEGVEASVTTFR

SEQ ID NO: 62 - protein, 15 aa, Salmonella enterica
TSASQYALFLEDEWR

SEQ ID NO: 63 - protein, 18 aa, Salmonella enterica
TPGGYVVWDTGAAWQATK

SEQ ID NO: 64 - protein, 18 aa, Salmonella enterica
EKDEQQSSATTATGETPR

SEQ ID NO: 65 - protein, 16 aa, Salmonella enterica
HNDFDLNWIPVDAIER

SEQ ID NO: 66 - protein, 17 aa, Salmonella enterica
IQGVETELKVPFNEAWK

SEQ ID NO: 67 - protein, 21 aa, Salmonella enterica
TPDVNAAPGYSNFVGFETNSR

SEQ ID NO: 68 - protein, 22 aa, Salmonella enterica
IVGSPDLKPETSESWELGLYYR

SEQ ID NO: 69 - protein, 24 aa, Salmonella enterica
DRGDTYNGQFFTSGPLIDGVLGMK

SEQ ID NO: 70 - protein, 24 aa, Salmonella enterica
DGNVEFAWTPNENHDVTAGYGFDR

SEQ ID NO: 71 - protein, 11 aa, Salmonella enterica
WQSTSVNDVLR

SEQ ID NO: 72 - protein, 11 aa, Salmonella enterica
YDSDYSAYPYR

SEQ ID NO: 73 - protein, 13 aa, Salmonella enterica
TLYGALEHTFSDR

SEQ ID NO: 74 - protein, 16 aa, Salmonella enterica
QWEGAFEGLTAGVSWR

SEQ ID NO: 75 - protein, 17 aa, Salmonella enterica
QTTTPGTGYVPEGYDQR

SEQ ID NO: 76 - protein, 17 aa, Salmonella enterica
TDYDAYYSPGSPLIDTR

SEQ ID NO: 77 - protein, 17 aa, Salmonella enterica
HGTWQTSAGWEFIEGYR

SEQ ID NO: 78 - protein, 21 aa, Salmonella enterica
LPGVDIAQSGGAGQNSSIFIR

SEQ ID NO: 79 - protein, 22 aa, Salmonella enterica
LNLAGVSGSADLSQFPVSLVQR

SEQ ID NO: 80 - protein, 11 aa, Salmonella enterica
DDAAGQAIANR

SEQ ID NO: 81 - protein, 11 aa, Salmonella enterica
SQSALGTAIER

SEQ ID NO: 82 - protein, 12 aa, Salmonella enterica
IDAALAQVDALR

SEQ ID NO: 83 - protein, 15 aa, Salmonella enterica
IEDSDYATEVSNMSR

SEQ ID NO: 84 - protein, 16 aa, Salmonella enterica
QINSQTLGLDSLNVQK

SEQ ID NO: 85 - protein, 17 aa, Salmonella enterica
SRIEDSDYATEVSNMSR

SEQ ID NO: 86 - protein, 19 aa, Salmonella enterica
FNSAITNLGNTVNNLSEAR

SEQ ID NO: 87 - protein, 25 aa, Salmonella enterica
NANDGISIAQTTEGALNEINNNLQR

SEQ ID NO: 88 - protein, 26 aa, Salmonella enterica
ELAVQSANSTNSQSDLDSIQAEITQR

SEQ ID NO: 89 - protein, 27 aa, Salmonella enterica
AQILQQAGTSVLAQANQVPQNVLSLLR

SEQ ID NO: 90 - protein, 28 aa, Salmonella enterica
VRELAVQSANSTNSQSDLDSIQAEITQR

SEQ ID NO: 91 - protein, 9 aa, Salmonella enterica
SDLGAVQNR

SEQ ID NO: 92 - protein, 11 aa, Salmonella enterica
DDAAGQAIANR

SEQ ID NO: 93 - protein, 11 aa, Salmonella enterica
SQSALGTAIER

SEQ ID NO: 94 - protein, 12 aa, Salmonella enterica
TALNQLGGADGK

SEQ ID NO: 95 - protein, 12 aa, Salmonella enterica
IDAALAQVDALR

SEQ ID NO: 96 - protein, 17 aa, Salmonella enterica
ADVDADGNVSLATGATK

SEQ ID NO: 97 - protein, 16 aa, Salmonella enterica
INSAKDDAAGQAIANR

SEQ ID NO: 98 - protein, 17 aa, Salmonella enterica
AGITGTTTETGSVKDGK

SEQ ID NO: 99 - protein, 15 aa, Salmonella enterica
YDVDSTGVTQSLDLK

SEQ ID NO: 100 - protein, 14 aa, Salmonella enterica
NYYVEVDFTDTTDK

SEQ ID NO: 101 - protein, 15 aa, Salmonella enterica
IEDSDYATEVSNMSR

SEQ ID NO: 102 - protein, 16 aa, Salmonella enterica
QINSQTLGLDTLNVQK

SEQ ID NO: 103 - protein, 17 aa, Salmonella enterica
LNEIDRVSGQTQFNGVK

SEQ ID NO: 104 - protein, 17 aa, Salmonella enterica
SRIEDSDYATEVSNMSR

SEQ ID NO: 105 - protein, 19 aa, Salmonella enterica
AQVINTNSLSLLTQNNLNK

SEQ ID NO: 106 - protein, 21 aa, Salmonella enterica
IDAALAQVDALRSDLGAVQNR

SEQ ID NO: 107 - protein, 25 aa, Salmonella enterica
NANDGISIAQTTEGALNEINNNLQR

SEQ ID NO: 108 - protein, 26 aa, Salmonella enterica
ELAVQSANSTNSQSDLDSIQAEITQR

SEQ ID NO: 109 - protein, 28 aa, Salmonella enterica
VRELAVQSANSTNSQSDLDSIQAEITQR

SEQ ID NO: 110 - protein, 7 aa, Salmonella enterica
SVVQTVR

SEQ ID NO: 111 - protein, 7 aa, Salmonella enterica
QQLANAR

SEQ ID NO: 112 - protein, 7 aa, Salmonella enterica
LSQDLAR

SEQ ID NO: 113 - protein, 7 aa, Salmonella enterica
LSNPELR

SEQ ID NO: 114 - protein, 8 aa, Salmonella enterica
NLSLLQAR

SEQ ID NO: 115 - protein, 10 aa, Salmonella enterica
ANSNNGNPFR

SEQ ID NO: 116 - protein, 11 aa, Salmonella enterica
NNLDNAVEELR

SEQ ID NO: 117 - protein, 11 aa, Salmonella enterica
YTYLINQLNIK

SEQ ID NO: 118 - protein, 14 aa, Salmonella enterica
AQYDTVLANEVTAR

SEQ ID NO: 119 - protein, 15 aa, Salmonella enterica
FNVGLVAITDVQNAR

SEQ ID NO: 120 - protein, 15 aa, Salmonella enterica
VLNAIDVLSYTQAQK

SEQ ID NO: 121 - protein, 16 aa, Salmonella enterica
TIVDVLDATTTLYDAK

SEQ ID NO: 122 - protein, 17 aa, Salmonella enterica
SSFNNINASISSINAYK

SEQ ID NO: 123 - protein, 18 aa, Salmonella enterica
QAQYNFVGASEQLESAHR

SEQ ID NO: 124 - protein, 20 aa, Salmonella enterica
SPLLPQLGLGADYTYSNGYR

SEQ ID NO: 125 - protein, 19 aa, Salmonella enterica
QVTGNYYPELASLNVEHFK

SEQ ID NO: 126 - protein, 22 aa, Salmonella enterica
QAVVSAQSSLDAMEAGYSVGTR

SEQ ID NO: 127 - protein, 25 aa, Salmonella enterica
DANGINSNETSASLQLTQTLFDMSK

SEQ ID NO: 128 - protein, 27 aa, Salmonella enterica
QAQDGHLPTLNLTASTGISDTSYSGSK

SEQ ID NO: 129 - protein, 26 aa, Salmonella enterica
AAGIQDVTYQTDQQTLILNTANAYFK

SEQ ID NO: 130 - protein, 5 aa, Salmonella enterica
WGYIK

SEQ ID NO: 131 - protein, 7 aa, Salmonella enterica
LSLAATR

SEQ ID NO: 132 - protein, 7 aa, Salmonella enterica
IFATYAK

SEQ ID NO: 133 - protein, 7 aa, Salmonella enterica
LGQEVWK

SEQ ID NO: 134 - protein, 8 aa, Salmonella enterica
VDFHGYAR

SEQ ID NO: 135 - protein, 10 aa, Salmonella enterica
DTANDVFDVR

SEQ ID NO: 136 - protein, 9 aa, Salmonella enterica
WDEKWGYIK

SEQ ID NO: 137 - protein, 14 aa, Salmonella enterica
YAAATNSGISTNSR

SEQ ID NO: 138 - protein, 12 aa, Salmonella enterica
WGYIKDGDNISR

SEQ ID NO: 139 - protein, 15 aa, Salmonella enterica
FVVQYATDAMTTQGK

SEQ ID NO: 140 - protein, 15 aa, Salmonella enterica
NLIEWLPGSTIWAGK

SEQ ID NO: 141 - protein, 15 aa, Salmonella enterica
DGWMFTAEHTQSMLK

SEQ ID NO: 142 - protein, 17 aa, Salmonella enterica
WTPIMSTLLEVGYDNVK

SEQ ID NO: 143 - protein, 20 aa, Salmonella enterica
LAGLQTNPDGVLELGVDYGR

SEQ ID NO: 144 - protein, 20 aa, Salmonella enterica
STEAGGSYTFSSQNIYDEVK

SEQ ID NO: 145 - protein, 20 aa, Salmonella enterica
ITLAQQWQAGDSIWSRPAIR

SEQ ID NO: 146 - protein, 26 aa, Salmonella enterica
SFYFDTNVAYSVNQQNDWESTDPAFR

SEQ ID NO: 147 - protein, 30 aa, Salmonella enterica
STEAGGSYTFSSQNIYDEVKDTANDVFDVR

SEQ ID NO: 148 - protein, 7 aa, Salmonella enterica
LAFAGLK

SEQ ID NO: 149 - protein, 8 aa, Salmonella enterica
TTGVATYR

SEQ ID NO: 150 - protein, 10 aa, Salmonella enterica
NAEVWAAGLK

SEQ ID NO: 151 - protein, 9 aa, Salmonella enterica
NMSTFVDYK

SEQ ID NO: 152 - protein, 10 aa, Salmonella enterica
DGNKLDLYGK

SEQ ID NO: 153 - protein, 11 aa, Salmonella enterica
FADYGSFDYGR

SEQ ID NO: 154 - protein, 15 aa, Salmonella enterica
VSTDNIVAVGLNYQF

SEQ ID NO: 155 - protein, 20 aa, Salmonella enterica
NTDFFGLVEGLNFAAQYQGK

SEQ ID NO: 156 - protein, 21 aa, Salmonella enterica
VHAQHYFSDDNGSDGDKTYAR

SEQ ID NO: 157 - protein, 20 aa, Salmonella enterica
GETQINDQLTGFGQWEYEFK

SEQ ID NO: 158 - protein, 23 aa, Salmonella enterica
NTDFFGLVEGLNFAAQYQGKNDR

SEQ ID NO: 159 - protein, 23 aa, Salmonella enterica
GETQINDQLTGFGQWEYEFKGNR

SEQ ID NO: 160 - protein, 24 aa, Salmonella enterica
NLGTYGDQDLVEYIDVGATYYFNK

SEQ ID NO: 161 - protein, 24 aa, Salmonella enterica
TQNFEAVAQYQFDFGLRPSIAYLK

SEQ ID NO: 162 - protein, 24 aa, Salmonella enterica
LGFKGETQINDQLTGFGQWEYEFK

SEQ ID NO: 163 - protein, 30 aa, Salmonella enterica
DGAYESNGDGFGLSATYEYEGFGVGAAYAK

SEQ ID NO: 164 - protein, 33 aa, Salmonella enterica
NDRDGAYESNGDGFGLSATYEYEGFGVGAAYAK

SEQ ID NO: 165 - protein, 7 aa, Salmonella enterica
VAFAGLK

SEQ ID NO: 166 - protein, 7 aa, Salmonella enterica
LYGNGDR

SEQ ID NO: 167 - protein, 8 aa, Salmonella enterica
GNGYATYR

SEQ ID NO: 168 - protein, 9 aa, Salmonella enterica
ATVYTGGLK

SEQ ID NO: 169 - protein, 10 aa, Salmonella enterica
DGNKLDLFGK

SEQ ID NO: 170 - protein, 17 aa, Salmonella enterica
LDLFGKVDGLNYFSDDK

SEQ ID NO: 171 - protein, 11 aa, Salmonella enterica
FADAGSFDYGR

SEQ ID NO: 172 - protein, 22 aa, Escherichia coli
YYTATSSGQLPSGSSPYDRDTR

SEQ ID NO: 173 - protein, 25 aa, Escherichia coli
NHDTGVSPVFAGGVEYAITPEIATR

SEQ ID NO: 174 - protein, 17 aa, Salmonella enterica
DISNGYGASYGDQDIVK

SEQ ID NO: 175 - protein, 18 aa, Salmonella enterica
FGTSNGSNPSTSYGFANK

SEQ ID NO: 176 - protein, 19 aa, Salmonella enterica
GKDISNGYGASYGDQDIVK

SEQ ID NO: 177 - protein, 20 aa, Salmonella enterica
NTDFFGLVDGLDFALQYQGK

SEQ ID NO: 178 - protein, 21 aa, Salmonella enterica
VDGLNYFSDDKGSDGDQTYMR

SEQ ID NO: 179 - protein, 31 aa, Escherichia coli
LEYQWTNNIGDAHTIGTRPDNGMLSLGVSYR

SEQ ID NO: 180 - protein, 26 aa, Salmonella enterica
AQNFEVVAQYQFDFGLRPSVAYLQSK

SEQ ID NO: 181 - protein, 32 aa, Salmonella enterica
SLLNQNGDGYGGSLTYAIGEGFSVGGAITTSK

SEQ ID NO: 182 - protein, 7 aa, Salmonella enterica
LGGMVWR

SEQ ID NO: 183 - protein, 7 aa, Salmonella enterica
RVEIEVK

SEQ ID NO: 184 - protein, 9 aa, Salmonella enterica
AQGVQLTAK

SEQ ID NO: 185 - protein, 9 aa, Salmonella enterica
DNTWYAGAK

SEQ ID NO: 186 - protein, 9 aa, Salmonella enterica
SDVLFNFNK

SEQ ID NO: 187 - protein, 11 aa, Salmonella enterica
AALIDCLAPDR

SEQ ID NO: 188 - protein, 12 aa, Salmonella enterica
DGSVVVLGFTDR

SEQ ID NO: 189 - protein, 12 aa, Salmonella enterica
RAQSVVDYLISK

SEQ ID NO: 190 - protein, 13 aa, Salmonella enterica
IGSDAYNQGLSEK

SEQ ID NO: 191 - protein, 14 aa, Salmonella enterica
IGSDAYNQGLSEKR

SEQ ID NO: 192 - protein, 14 aa, Salmonella enterica
LGYPITDDLDVYTR

SEQ ID NO: 193 - protein, 23 aa, Salmonella enterica
FGQQEAAPVVAPAPAPAPEVQTK

SEQ ID NO: 194 - protein, 25 aa, Salmonella enterica
DHDTGVSPVFAGGIEYAITPEIATR

SEQ ID NO: 195 - protein, 24 aa, Salmonella enterica
STLKPEGQQALDQLYSQLSNLDPK

SEQ ID NO: 196 - protein, 31 aa, Salmonella enterica
LEYQWTNNIGDANTIGTRPDNGLLSVGVSYR

SEQ ID NO: 197 - protein, 9 aa, Salmonella enterica
IYDDAAVER

SEQ ID NO: 198 - protein, 9 aa, Salmonella enterica
VDGKLIFER

SEQ ID NO: 199 - protein, 10 aa, Salmonella enterica
QAEGQPEPVR

SEQ ID NO: 200 - protein, 9 aa, Salmonella enterica
VQYLYVPYR

SEQ ID NO: 201 - protein, 12 aa, Salmonella enterica
YGSSTDGYATQK

SEQ ID NO: 202 - protein, 24 aa, Salmonella enterica
VRPYVGVGVNYTTFFDNDFNDNGK

SEQ ID NO: 203 - protein, 27 aa, Salmonella enterica
NAGLSDLSFKDSWGAAGQVGVDYLINR

SEQ ID NO: 204 - protein, 31 aa, Salmonella enterica
VGTGATGDIATVHLLPPTLMAQWYFGDSSSK

SEQ ID NO: 205 - protein, 7 aa, Salmonella enterica
MSGFNLK

SEQ ID NO: 206 - protein, 10 aa, Salmonella enterica
FQTTDYPTYK

SEQ ID NO: 207 - protein, 13 aa, Salmonella enterica
GQYYGITAGPAYR

SEQ ID NO: 208 - protein, 14 aa, Salmonella enterica
SVDVGTWIAGVGYR

SEQ ID NO: 209 - protein, 15 aa, Salmonella enterica
SVDVGTWIAGVGYRF

SEQ ID NO: 210 - protein, 17 aa, Salmonella enterica
LNDWASIYGVVGVGYGK

SEQ ID NO: 211 - protein, 19 aa, Salmonella enterica
YEQDDNPLGVIGSFTYTEK

SEQ ID NO: 212 - protein, 21 aa, Salmonella enterica
YEQDDNPLGVIGSFTYTEKDR

SEQ ID NO: 213 - protein, 21 aa, Salmonella enterica
YRYEQDDNPLGVIGSFTYTEK

SEQ ID NO: 214 - protein, 7 aa, Salmonella enterica
LDNQATK

SEQ ID NO: 215 - protein, 12 aa, Salmonella enterica
SDVQAAKDDAAR

SEQ ID NO: 216 - protein, 11 aa, Salmonella enterica
ANQRLDNQATK

SEQ ID NO: 217 - protein, 12 aa, Salmonella enterica
VDQLSNDVNAMR

SEQ ID NO: 218 - protein, 14 aa, Salmonella enterica
IDQLSSDVQTLNAK

SEQ ID NO: 219 - protein, 19 aa, Salmonella enterica
VDQLSNDVNAMRSDVQAAK

SEQ ID NO: 220 - protein, 26 aa, Salmonella enterica
IDQLSSDVQTLNAKVDQLSNDVNAMR

SEQ ID NO: 221 - protein, 6 aa, Salmonella enteritidis
WVVLGR

SEQ ID NO: 222 - protein, 6 aa, Salmonella enteritidis
SYYLDR

SEQ ID NO: 223 - protein, 7 aa, Salmonella enteritidis
YGYAYPR

SEQ ID NO: 224 - protein, 9 aa, Salmonella enteritidis
AGLGYVHNK

SEQ ID NO: 225 - protein, 9 aa, Salmonella enteritidis
QNLEASGVR

SEQ ID NO: 226 - protein, 9 aa, Salmonella enteritidis
LAGDLETLR

SEQ ID NO: 227 - protein, 9 aa, Salmonella enteritidis
GYFPTDGSR

SEQ ID NO: 228 - protein, 10 aa, Salmonella enteritidis
WGYGDGLGGK

SEQ ID NO: 229 - protein, 10 aa, Salmonella enteritidis
GFQSNTIGPK

SEQ ID NO: 230 - protein, 10 aa, Salmonella enteritidis
LVFQEGVSAK

SEQ ID NO: 231 - protein, 9 aa, Salmonella enteritidis
DIHFEGLQR

SEQ ID NO: 232 - protein, 10 aa, Salmonella enteritidis
AEQFQFNIGK

SEQ ID NO: 233 - protein, 11 aa, Salmonella enteritidis
IEPGELYNGTK

SEQ ID NO: 234 - protein, 11 aa, Salmonella enteritidis
GLEDFYYSVGK

SEQ ID NO: 235 - protein, 13 aa, Salmonella enteritidis
VAVGAALLSMPVR

SEQ ID NO: 236 - protein, 12 aa, Salmonella enteritidis
ALFATGNFEDVR

SEQ ID NO: 237 - protein, 12 aa, Salmonella enteritidis
VTIPGSDNEYYK

SEQ ID NO: 238 - protein, 13 aa, Salmonella enteritidis
VPGSPDQVDVVYK

SEQ ID NO: 239 - protein, 12 aa, Salmonella enteritidis
LSNMQPQIAMDR

SEQ ID NO: 240 - protein, 12 aa, Salmonella enteritidis
DEVPWWNVVGDR

SEQ ID NO: 241 - protein, 14 aa, Salmonella enteritidis
ERPTIASITFSGNK

SEQ ID NO: 242 - protein, 13 aa, Salmonella enteritidis
LGFFETVDTDTQR

SEQ ID NO: 243 - protein, 15 aa, Salmonella enteritidis
TGDTVNDEDISNTIR

SEQ ID NO: 244 - protein, 15 aa, Salmonella enteritidis
FNIDSTQVSLTPDKK

SEQ ID NO: 245 - protein, 10 aa, Salmonella enteritidis
GNIMWENEFR

SEQ ID NO: 246 - protein, 11 aa, Salmonella enteritidis
LQADEVQLHQK

SEQ ID NO: 247 - protein, 11 aa, Salmonella enteritidis
EEQVAEIWNAR

SEQ ID NO: 248 - protein, 12 aa, Salmonella enteritidis
IYGQAVHFVNTK

SEQ ID NO: 249 - protein, 14 aa, Salmonella enteritidis
IASANQVTTGVTTR

SEQ ID NO: 250 - protein, 11 aa, Salmonella enteritidis
RGNIMWENEFR

SEQ ID NO: 251 - protein, 13 aa, Salmonella enteritidis
VSDSSYFNDFDSK

SEQ ID NO: 252 - protein, 13 aa, Salmonella enteritidis
TGSLVWAGDTYWR

SEQ ID NO: 253 - protein, 14 aa, Salmonella enteritidis
VHLEPTINLPLSNR

SEQ ID NO: 254 - protein, 13 aa, Salmonella enteritidis
EEQVAEIWNARFK

SEQ ID NO: 255 - protein, 15 aa, Salmonella enteritidis
GLSSNYGLGTQEMLR

SEQ ID NO: 256 - protein, 14 aa, Salmonella enteritidis
DTNVWEGDYQMVGR

SEQ ID NO: 257 - protein, 17 aa, Salmonella enteritidis
NGINQVGAVASWPIADR

SEQ ID NO: 258 - protein, 17 aa, Salmonella enteritidis
NGINQVGAVASWPIADR

SEQ ID NO: 259 - protein, 16 aa, Salmonella enteritidis
DMAMLAPGYTQTLEPR

SEQ ID NO: 260 - protein, 15 aa, Salmonella enteritidis
FNVSVGQIYYFTESR

SEQ ID NO: 261 - protein, 17 aa, Salmonella enteritidis
FSVGYAVQNFDATVSTK

SEQ ID NO: 262 - protein, 18 aa, Salmonella enteritidis
TVDALGNVHYDDNQVILK

SEQ ID NO: 263 - protein, 19 aa, Salmonella enteritidis
VGPVPIFYSPYLQLPVGDK

SEQ ID NO: 264 - protein, 21 aa, Salmonella enteritidis
GNYPDDAVFTGNVDIMQGNSR

SEQ ID NO: 265 - protein, 19 aa, Salmonella enteritidis
WENDDKTGSLVWAGDTYWR

SEQ ID NO: 266 - protein, 21 aa, Salmonella enteritidis
LMATHYQQTNLDSYNSDPNNK

SEQ ID NO: 267 - protein, 22 aa, Salmonella enteritidis
DQSGIYNYDSSLLQSDYNGLFR

SEQ ID NO: 268 - protein, 22 aa, Salmonella enteritidis
YASPEYIQATLPSYYSTAEQYK

SEQ ID NO: 269 - protein, 5 aa, Salmonella enteritidis
QIDIR

SEQ ID NO: 270 - protein, 7 aa, Salmonella enteritidis
LGWRGER

SEQ ID NO: 271 - protein, 7 aa, Salmonella enteritidis
ETNRLYR

SEQ ID NO: 272 - protein, 8 aa, Salmonella enteritidis
EIGLEFKR

SEQ ID NO: 273 - protein, 10 aa, Salmonella enteritidis
IEAGTVPLQR

SEQ ID NO: 274 - protein, 9 aa, Salmonella enteritidis
GNNRQIDIR

SEQ ID NO: 275 - protein, 9 aa, Salmonella enteritidis
DNYGKETNR

SEQ ID NO: 276 - protein, 11 aa, Salmonella enteritidis
IEVLRGPAAAR

SEQ ID NO: 277 - protein, 10 aa, Salmonella enteritidis
NINQGHQSER

SEQ ID NO: 278 - protein, 12 aa, Salmonella enteritidis
TGSYADTLPAGR

SEQ ID NO: 279 - protein, 12 aa, Salmonella enteritidis
NKIEAGTVPLQR

SEQ ID NO: 280 - protein, 12 aa, Salmonella enteritidis
NPPARDVSEIIR

SEQ ID NO: 281 - protein, 11 aa, Salmonella enteritidis
TDVYQWENVPK

SEQ ID NO: 282 - protein, 13 aa, Salmonella enteritidis
EGVINKDINGVVR

SEQ ID NO: 283 - protein, 15 aa, Salmonella enteritidis
YGNGAAGGVVNIITK

SEQ ID NO: 284 - protein, 13 aa, Salmonella enteritidis
LYGNLDKTQADAR

SEQ ID NO: 285 - protein, 13 aa, Salmonella enteritidis
GDTAWVPPEMIER

SEQ ID NO: 286 - protein, 16 aa, Salmonella enteritidis
YGNGAAGGVVNIITKK

SEQ ID NO: 287 - protein, 16 aa, Salmonella enteritidis
YGNGAAGGVVNIITKK

SEQ ID NO: 288 - protein, 14 aa, Salmonella enteritidis
KYDYQGNPVTGTDK

SEQ ID NO: 289 - protein, 16 aa, Salmonella enteritidis
TMPGVNLTGNSTSGQR

SEQ ID NO: 290 - protein, 15 aa, Salmonella enteritidis
NVSLTGGVDNLFDKR

SEQ ID NO: 291 - protein, 15 aa, Salmonella enteritidis
NVSLTGGVDNLFDKR

SEQ ID NO: 292 - protein, 16 aa, Salmonella enteritidis
TNFSLNGPLGGDFSFR

SEQ ID NO: 293 - protein, 16 aa, Salmonella enteritidis
APSLYQTNPNYILYSK

SEQ ID NO: 294 - protein, 16 aa, Salmonella enteritidis
INNGKTDVYQWENVPK

SEQ ID NO: 295 - protein, 19 aa, Salmonella enteritidis
NSRMPEGLAGGTEGIFDPK

SEQ ID NO: 296 - protein, 17 aa, Salmonella enteritidis
WDFAPLQSLELEAGYSR

SEQ ID NO: 297 - protein, 19 aa, Salmonella enteritidis
GMGPENTLILIDGKPVTSR

SEQ ID NO: 298 - protein, 19 aa, Salmonella enteritidis
QGNLYAGDTQNTNTNQLVK

SEQ ID NO: 299 - protein, 21 aa, Salmonella enteritidis
DTQTGAYMAGAGAYTYNEPGR

SEQ ID NO: 300 - protein, 19 aa, Salmonella enteritidis
AYKAPSLYQTNPNYILYSK

SEQ ID NO: 301 - protein, 22 aa, Salmonella enteritidis
NINQGHQSERTGSYADTLPAGR

SEQ ID NO: 302 - protein, 23 aa, Salmonella enteritidis
TNFSLNGPLGGDFSFRLYGNLDK

SEQ ID NO: 303 - protein, 24 aa, Salmonella enteritidis
QIDIRGMGPENTLILIDGKPVTSR

SEQ ID NO: 304 - protein, 24 aa, Salmonella enteritidis
MKDQLSNSQTFMGGNIPGYSSTNR

SEQ ID NO: 305 - protein, 28 aa, Salmonella enteritidis
FDHHSIVGDNWSPSLNLSQGLGDDFTLK

SEQ ID NO: 306 - protein, 27 aa, Salmonella enteritidis
QNYSLTWNGGWNNGVTTSNWVQYEHTR

SEQ ID NO: 307 - protein, 31 aa, Salmonella enteritidis
DTQTGAYMAGAGAYTYNEPGRTWYMSINTHF

SEQ ID NO: 308 - protein, 4 aa, Salmonella enteritidis
YSWR

SEQ ID NO: 309 - protein, 5 aa, Salmonella enteritidis
IEVIR

SEQ ID NO: 310 - protein, 7 aa, Salmonella enteritidis
LYGNLNR

SEQ ID NO: 311 - protein, 7 aa, Salmonella enteritidis
LGFYYEK

SEQ ID NO: 312 - protein, 10 aa, Salmonella enteritidis
IVAGDQIIGR

SEQ ID NO: 313 - protein, 10 aa, Salmonella enteritidis
QQPGVSIITR

SEQ ID NO: 314 - protein, 10 aa, Salmonella enteritidis
NLDPEISINK

SEQ ID NO: 315 - protein, 11 aa, Salmonella enteritidis
DTGNPLSIIPK

SEQ ID NO: 316 - protein, 12 aa, Salmonella enteritidis
MNEGLSGGGEGR

SEQ ID NO: 317 - protein, 11 aa, Salmonella enteritidis
LNVGISNIFDK

SEQ ID NO: 318 - protein, 11 aa, Salmonella enteritidis
ITNDQTFTTNR

SEQ ID NO: 319 - protein, 12 aa, Salmonella enteritidis
NPPVNDLADIIR

SEQ ID NO: 320 - protein, 14 aa, Salmonella enteritidis
DSNIAGIPGSAANR

SEQ ID NO: 321 - protein, 13 aa, Salmonella enteritidis
SAEGANTYNEPGR

SEQ ID NO: 322 - protein, 15 aa, Salmonella enteritidis
YGSGAAGGVVNIITK

SEQ ID NO: 323 - protein, 15 aa, Salmonella enteritidis
MPGVNLTGNSASGTR

SEQ ID NO: 324 - protein, 13 aa, Salmonella enteritidis
GDTNWVPPEMVER

SEQ ID NO: 325 - protein, 15 aa, Salmonella enteritidis
SASGAYVLQWQNGGK

SEQ ID NO: 326 - protein, 15 aa, Salmonella enteritidis
SASGAYVLQWQNGGK

SEQ ID NO: 327 - protein, 17 aa, Salmonella enteritidis
GNFSLSGPLAGDTLTMR

SEQ ID NO: 328 - protein, 15 aa, Salmonella enteritidis
EGVTNKDINSVFSWR

SEQ ID NO: 329 - protein, 15 aa, Salmonella enteritidis
MTPQQILDFEAGYSR

SEQ ID NO: 330 - protein, 16 aa, Salmonella enteritidis
APNLYQTSEGYLLYSK

SEQ ID NO: 331 - protein, 18 aa, Salmonella enteritidis
ALGAYSLVGANVNYDINK

SEQ ID NO: 332 - protein, 18 aa, Salmonella enteritidis
ALIEGIEASMAVPLMPDR

SEQ ID NO: 333 - protein, 19 aa, Salmonella enteritidis
GMGPENTLVLIDGVPVTSR

SEQ ID NO: 334 - protein, 17 aa, Salmonella enteritidis
QNYGLTHNGIWDWGQSR

SEQ ID NO: 335 - protein, 19 aa, Salmonella enteritidis
EIGLEFTVDDYHASVTYFR

SEQ ID NO: 336 - protein, 22 aa, Salmonella enteritidis
LYGNLNRTDADSWDINSSAGTK

SEQ ID NO: 337 - protein, 21 aa, Salmonella enteritidis
RPTNDWHGSLSLYTNQPESSK

SEQ ID NO: 338 - protein, 25 aa, Salmonella enteritidis
SEISALYVEDNIEPMAGTNIIPGLR

SEQ ID NO: 339 - protein, 26 aa, Salmonella enteritidis
FDYLSESGSNFSPSLNLSQELGEYVK

SEQ ID NO: 340 - protein, 27 aa, Salmonella enteritidis
NKSEISALYVEDNIEPMAGTNIIPGLR

SEQ ID NO: 341 - protein, 5 aa, Salmonella enteritidis
NAVFR

SEQ ID NO: 342 - protein, 5 aa, Salmonella enteritidis
IEVVR

SEQ ID NO: 343 - protein, 5 aa, Salmonella enteritidis
VPVFR

SEQ ID NO: 344 - protein, 7 aa, Salmonella enteritidis
IEGFTSR

SEQ ID NO: 345 - protein, 8 aa, Salmonella enteritidis
GGWATAFK

SEQ ID NO: 346 - protein, 8 aa, Salmonella enteritidis
VPFNEAWK

SEQ ID NO: 347 - protein, 9 aa, Salmonella enteritidis
WDLGNSELK

SEQ ID NO: 348 - protein, 8 aa, Salmonella enteritidis
YFMAVDYR

SEQ ID NO: 349 - protein, 11 aa, Salmonella enteritidis
LRAGVLNVGDK

SEQ ID NO: 350 - protein, 10 aa, Salmonella enteritidis
QNYALSHNGR

SEQ ID NO: 351 - protein, 10 aa, Salmonella enteritidis
QDRDSDSLDK

SEQ ID NO: 352 - protein, 10 aa, Salmonella enteritidis
QDRDSDSLDK

SEQ ID NO: 353 - protein, 9 aa, Salmonella enteritidis
YFMAVDYRF

SEQ ID NO: 354 - protein, 11 aa, Salmonella enteritidis
LSLNYTYNDGR

SEQ ID NO: 355 - protein, 12 aa, Salmonella enteritidis
IFEPLALTTGIR

SEQ ID NO: 356 - protein, 11 aa, Salmonella enteritidis
DDYGYTEDGRR

SEQ ID NO: 357 - protein, 14 aa, Salmonella enteritidis
GLDSSYTLILIDGK

SEQ ID NO: 358 - protein, 14 aa, Salmonella enteritidis
EVPGVQLTNEGDNR

SEQ ID NO: 359 - protein, 14 aa, Salmonella enteritidis
AYLVYNATDTLTVK

SEQ ID NO: 360 - protein, 15 aa, Salmonella enteritidis
GLDSSYTLILIDGKR

SEQ ID NO: 361 - protein, 15 aa, Salmonella enteritidis
EVPGVQLTNEGDNRK

SEQ ID NO: 362 - protein, 16 aa, Salmonella enteritidis
DAPASISVITQQDLQR

SEQ ID NO: 363 - protein, 14 aa, Salmonella enteritidis
MDDHETYGDHWSPR

SEQ ID NO: 364 - protein, 15 aa, Salmonella enteritidis
WHGSVTVDSTIQEHR

SEQ ID NO: 365 - protein, 17 aa, Salmonella enteritidis
GEEGILEGVEASVTTFR

SEQ ID NO: 366 - protein, 15 aa, Salmonella enteritidis
TSASQYALFLEDEWR

SEQ ID NO: 367 - protein, 18 aa, Salmonella enteritidis
TPGGYVVWDTGAAWQATK

SEQ ID NO: 368 - protein, 16 aa, Salmonella enteritidis
HNDFDLNWIPVDAIER

SEQ ID NO: 369 - protein, 21 aa, Salmonella enteritidis
TPDVNAAPGYSNFVGFETNSR

SEQ ID NO: 370 - protein, 22 aa, Salmonella enteritidis
IVGSPDLKPETSESWELGLYYR

SEQ ID NO: 371 - protein, 22 aa, Salmonella enteritidis
DGNVEFAWTPNENHDVTAGYGF

SEQ ID NO: 372 - protein, 7 aa, Salmonella enteritidis
SVVQTVR

SEQ ID NO: 373 - protein, 7 aa, Salmonella enteritidis
LSQDLAR

SEQ ID NO: 374 - protein, 8 aa, Salmonella enteritidis
NLSLLQAR

SEQ ID NO: 375 - protein, 11 aa, Salmonella enteritidis
SAADRDAAFEK

SEQ ID NO: 376 - protein, 11 aa, Salmonella enteritidis
ANSNNGNPFRH

SEQ ID NO: 377 - protein, 11 aa, Salmonella enteritidis
ANSNNGNPFRH

SEQ ID NO: 378 - protein, 11 aa, Salmonella enteritidis
NNLDNAVEELR

SEQ ID NO: 379 - protein, 11 aa, Salmonella enteritidis
YTYLINQLNIK

SEQ ID NO: 380 - protein, 14 aa, Salmonella enteritidis
AQYDTVLANEVTAR

SEQ ID NO: 381 - protein, 15 aa, Salmonella enteritidis
FNVGLVAITDVQNAR

SEQ ID NO: 382 - protein, 15 aa, Salmonella enteritidis
VLNAIDVLSYTQAQK

SEQ ID NO: 383 - protein, 16 aa, Salmonella enteritidis
TIVDVLDATTTLYDAK

SEQ ID NO: 384 - protein, 17 aa, Salmonella enteritidis
SSFNNINASISSINAYK

SEQ ID NO: 385 - protein, 18 aa, Salmonella enteritidis
QAQYNFVGASEQLESAHR

SEQ ID NO: 386 - protein, 20 aa, Salmonella enteritidis
SPLLPQLGLGADYTYSNGYR

SEQ ID NO: 387 - protein, 19 aa, Salmonella enteritidis
QVTGNYYPELASLNVEHFK

SEQ ID NO: 388 - protein, 22 aa, Salmonella enteritidis
QAVVSAQSSLDAMEAGYSVGTR

SEQ ID NO: 389 - protein, 27 aa, Salmonella enteritidis
QAQDGHLPTLNLTASTGISDTSYSGSK

SEQ ID NO: 390 - protein, 26 aa, Salmonella enteritidis
AAGIQDVTYQTDQQTLILNTANAYFK

SEQ ID NO: 391 - protein, 6 aa, Salmonella enteritidis
LDLFGK

SEQ ID NO: 392 - protein, 7 aa, Salmonella enteritidis
VAFAGLK

SEQ ID NO: 393 - protein, 8 aa, Salmonella enteritidis
GNGYATYR

SEQ ID NO: 394 - protein, 9 aa, Salmonella enteritidis
ATVYTGGLK

SEQ ID NO: 395 - protein, 9 aa, Salmonella enteritidis
STSYGFANK

SEQ ID NO: 396 - protein, 10 aa, Salmonella enteritidis
DGNKLDLFGK

SEQ ID NO: 397 - protein, 10 aa, Salmonella enteritidis
GSDGDQTYMR

SEQ ID NO: 398 - protein, 12 aa, Salmonella enteritidis
NGSVSGENTNGR

SEQ ID NO: 399 - protein, 11 aa, Salmonella enteritidis
FADAGSFDYGR

SEQ ID NO: 400 - protein, 12 aa, Salmonella enteritidis
YVDVGATYYFNK

SEQ ID NO: 401 - protein, 17 aa, Salmonella enteritidis
DISNGYGASYGDQDIVK

SEQ ID NO: 402 - protein, 18 aa, Salmonella enteritidis
VAFAGLKFADAGSFDYGR

SEQ ID NO: 403 - protein, 18 aa, Salmonella enteritidis
TADQNNTADEHLYGNGDR

SEQ ID NO: 404 - protein, 20 aa, Salmonella enteritidis
NTDFFGLVDGLDFALQYQGK

SEQ ID NO: 405 - protein, 20 aa, Salmonella enteritidis
YDANNIYLAAQYSQTYNATR

SEQ ID NO: 406 - protein, 21 aa, Salmonella enteritidis
VDGLHYFSDDKGSDGDQTYMR

SEQ ID NO: 407 - protein, 23 aa, Salmonella enteritidis
AQNFEVVAQYQFDFGLRPSVAYL

SEQ ID NO: 408 - protein, 7 aa, Salmonella enteritidis
LAFAGLK

SEQ ID NO: 409 - protein, 8 aa, Salmonella enteritidis
TTGVATYR

SEQ ID NO: 410 - protein, 10 aa, Salmonella enteritidis
NAEVWAAGLK

SEQ ID NO: 411 - protein, 9 aa, Salmonella enteritidis
NMSTFVDYK

SEQ ID NO: 412 - protein, 10 aa, Salmonella enteritidis
DGNKLDLYGK

SEQ ID NO: 413 - protein, 11 aa, Salmonella enteritidis
INLLDDSDFTK

SEQ ID NO: 414 - protein, 11 aa, Salmonella enteritidis
FADYGSFDYGR

SEQ ID NO: 415 - protein, 15 aa, Salmonella enteritidis
VSTDNIVAVGLNYQF

SEQ ID NO: 416 - protein, 17 aa, Salmonella enteritidis
VHAQHYFSDDNGSDGDK

SEQ ID NO: 417 - protein, 20 aa, Salmonella enteritidis
NTDFFGLVEGLNFAAQYQGK

SEQ ID NO: 418 - protein, 20 aa, Salmonella enteritidis
NTDFFGLVEGLNFAAQYQGK

SEQ ID NO: 419 - protein, 21 aa, Salmonella enteritidis
VHAQHYFSDDNGSDGDKTYAR

SEQ ID NO: 420 - protein, 20 aa, Salmonella enteritidis
GETQINDQLTGFGQWEYEFK

SEQ ID NO: 421 - protein, 24 aa, Salmonella enteritidis
NLGTYGDQDLVEYIDVGATYYFNK

SEQ ID NO: 422 - protein, 24 aa, Salmonella enteritidis
TQNFEAVAQYQFDFGLRPSIAYLK

SEQ ID NO: 423 - protein, 28 aa, Salmonella enteritidis
TTGVATYRNTDFFGLVEGLNFAAQYQGK

SEQ ID NO: 424 - protein, 7 aa, Salmonella enteritidis
LGGMVWR

SEQ ID NO: 425 - protein, 9 aa, Salmonella enteritidis
DNTWYAGAK

SEQ ID NO: 426 - protein, 9 aa, Salmonella enteritidis
SDVLFNFNK

SEQ ID NO: 427 - protein, 11 aa, Salmonella enteritidis
AALIDCLAPDR

SEQ ID NO: 428 - protein, 11 aa, Salmonella enteritidis
AQSVVDYLISK

SEQ ID NO: 429 - protein, 11 aa, Salmonella enteritidis
LGGMVWRADTK

SEQ ID NO: 430 - protein, 12 aa, Salmonella enteritidis
DGSVVVLGFTDR

SEQ ID NO: 431 - protein, 12 aa, Salmonella enteritidis
RAQSVVDYLISK

SEQ ID NO: 432 - protein, 13 aa, Salmonella enteritidis
IGSDAYNQGLSEK

SEQ ID NO: 433 - protein, 13 aa, Salmonella enteritidis
MPYKGDNINGAYK

SEQ ID NO: 434 - protein, 14 aa, Salmonella enteritidis
IGSDAYNQGLSEKR

SEQ ID NO: 435 - protein, 14 aa, Salmonella enteritidis
LGYPITDDLDVYTR

SEQ ID NO: 436 - protein, 23 aa, Salmonella enteritidis
FGQQEAAPVVAPAPAPAPEVQTK

SEQ ID NO: 437 - protein, 25 aa, Salmonella enteritidis
DHDTGVSPVFAGGIEYAITPEIATR

SEQ ID NO: 438 - protein, 24 aa, Salmonella enteritidis
STLKPEGQQALDQLYSQLSNLDPK

SEQ ID NO: 439 - protein, 31 aa, Salmonella enteritidis; identical to SEQ ID NO: 196

SEQ ID NO: 440 - protein, 8 aa, Salmonella enteritidis
EIGLEFKR

SEQ ID NO: 441 - protein, 10 aa, Salmonella enteritidis
IEAGTVPLQR

SEQ ID NO: 442 - protein, 10 aa, Salmonella enteritidis
NINQGHQSER

SEQ ID NO: 443 - protein, 12 aa, Salmonella enteritidis
TGSYADTLPAGR

SEQ ID NO: 444 - protein, 11 aa, Salmonella enteritidis
DGWLAGVTWFR

SEQ ID NO: 445 - protein, 12 aa, Salmonella enteritidis
NKIEAGTVPLQR

SEQ ID NO: 446 - protein, 11 aa, Salmonella enteritidis
TDVYQWENVPK

SEQ ID NO: 447 - protein, 15 aa, Salmonella enteritidis
YGNGAAGGVVNIITK

SEQ ID NO: 448 - protein, 14 aa, Salmonella enteritidis
NVSLTGGVDNLFDK

SEQ ID NO: 449 - protein, 13 aa, Salmonella enteritidis
GDTAWVPPEMIER

SEQ ID NO: 450 - protein, 14 aa, Salmonella enteritidis
KYDYQGNPVTGTDK

SEQ ID NO: 451 - protein, 16 aa, Salmonella enteritidis
MPEGLAGGTEGIFDPK

SEQ ID NO: 452 - protein, 16 aa, Salmonella enteritidis
TMPGVNLTGNSTSGQR

SEQ ID NO: 453 - protein, 15 aa, Salmonella enteritidis
NVSLTGGVDNLFDKR

SEQ ID NO: 454 - protein, 14 aa, Salmonella enteritidis
QDVSLQSTFTWYGK

SEQ ID NO: 455 - protein, 16 aa, Salmonella enteritidis
TNFSLNGPLGGDFSFR

SEQ ID NO: 456 - protein, 16 aa, Salmonella enteritidis
APSLYQTNPNYILYSK

SEQ ID NO: 457 - protein, 17 aa, Salmonella enteritidis
WDFAPLQSLELEAGYSR

SEQ ID NO: 458 - protein, 19 aa, Salmonella enteritidis
GMGPENTLILIDGKPVTSR

SEQ ID NO: 459 - protein, 19 aa, Salmonella enteritidis
QAVSPYSIVGLSATWDVTK

SEQ ID NO: 460 - protein, 19 aa, Salmonella enteritidis
QGNLYAGDTQNTNTNQLVK

SEQ ID NO: 461 - protein, 18 aa, Salmonella enteritidis
LSIIPQYTLNSTLSWQVR

SEQ ID NO: 462 - protein, 21 aa, Salmonella enteritidis
DTQTGAYMAGAGAYTYNEPGR

SEQ ID NO: 463 - protein, 19 aa, Salmonella enteritidis
GGSEWHGSWNTYFNAPEHK

SEQ ID NO: 464 - protein, 20 aa, Salmonella enteritidis
KGGSEWHGSWNTYFNAPEHK

SEQ ID NO: 465 - protein, 22 aa, Salmonella enteritidis
DQLSNSQTFMGGNIPGYSSTNR

SEQ ID NO: 466 - protein, 24 aa, Salmonella enteritidis
MKDQLSNSQTFMGGNIPGYSSTNR

SEQ ID NO: 467 - protein, 28 aa, Salmonella enteritidis
FDHHSIVGDNWSPSLNLSQGLGDDFTLK

SEQ ID NO: 468 - protein, 4 aa, Salmonella enteritidis
YSWR

SEQ ID NO: 469 - protein, 7 aa, Salmonella enteritidis
LYGNLNR

SEQ ID NO: 470 - protein, 7 aa, Salmonella enteritidis
LGFYYEK

SEQ ID NO: 471 - protein, 10 aa, Salmonella enteritidis
IVAGDQIIGR

SEQ ID NO: 472 - protein, 9 aa, Salmonella enteritidis
DINSVFSWK

SEQ ID NO: 473 - protein, 10 aa, Salmonella enteritidis
QQPGVSIITR

SEQ ID NO: 474 - protein, 11 aa, Salmonella enteritidis
DTGNPLSIIPK

SEQ ID NO: 475 - protein, 12 aa, Salmonella enteritidis
MNEGLSGGGEGR

SEQ ID NO: 476 - protein, 10 aa, Salmonella enteritidis
QKPRTHAESR

SEQ ID NO: 477 - protein, 11 aa, Salmonella enteritidis
LNVGISNIFDK

SEQ ID NO: 478 - protein, 11 aa, Salmonella enteritidis
ITNDQTFTTNR

SEQ ID NO: 479 - protein, 12 aa, Salmonella enteritidis
NPPVNDLADIIR

SEQ ID NO: 480 - protein, 14 aa, Salmonella enteritidis
DSNIAGIPGSAANR

SEQ ID NO: 481 - protein, 13 aa, Salmonella enteritidis
SAEGANTYNEPGR

SEQ ID NO: 482 - protein, 15 aa, Salmonella enteritidis
YGSGAAGGVVNIITK

SEQ ID NO: 483 - protein, 13 aa, Salmonella enteritidis
GDTNWVPPEMVER

SEQ ID NO: 484 - protein, 15 aa, Salmonella enteritidis
SASGAYVLQWQNGGK

SEQ ID NO: 485 - protein, 15 aa, Salmonella enteritidis
TDADSWDINSSAGTK

SEQ ID NO: 486 - protein, 17 aa, Salmonella enteritidis
GNFSLSGPLAGDTLTMR

SEQ ID NO: 487 - protein, 15 aa, Salmonella enteritidis
MTPQQILDFEAGYSR

SEQ ID NO: 488 - protein, 16 aa, Salmonella enteritidis
APNLYQTSEGYLLYSK

SEQ ID NO: 489 - protein, 18 aa, Salmonella enteritidis
ALGAYSLVGANVNYDINK

SEQ ID NO: 490 - protein, 16 aa, Salmonella enteritidis
LNWNTNATYMIASEQK

SEQ ID NO: 491 - protein, 18 aa, Salmonella enteritidis
ALIEGIEASMAVPLMPDR

SEQ ID NO: 492 - protein, 16 aa, Salmonella enteritidis
ITNDQTFTTNRLTSYR

SEQ ID NO: 493 - protein, 19 aa, Salmonella enteritidis
GMGPENTLVLIDGVPVTSR

SEQ ID NO: 494 - protein, 17 aa, Salmonella enteritidis
QNYGLTHNGIWDWGQSR

SEQ ID NO: 495 - protein, 19 aa, Salmonella enteritidis
AFKAPNLYQTSEGYLLYSK

SEQ ID NO: 496 - protein, 19 aa, Salmonella enteritidis
EIGLEFTVDDYHASVTYFR

SEQ ID NO: 497 - protein, 21 aa, Salmonella enteritidis
RPTNDWHGSLSLYTNQPESSK

SEQ ID NO: 498 - protein, 23 aa, Salmonella enteritidis
DITSGGCYLVGNKNLDPEISINK

SEQ ID NO: 499 - protein, 25 aa, Salmonella enteritidis
SEISALYVEDNIEPMAGTNIIPGLR

SEQ ID NO: 500 - protein, 26 aa, Salmonella enteritidis
FDYLSESGSNFSPSLNLSQELGEYVK

SEQ ID NO: 501 - protein, 27 aa, Salmonella enteritidis
NKSEISALYVEDNIEPMAGTNIIPGLR

SEQ ID NO: 502 - protein, 8 aa, Salmonella enteritidis
GQRVPVFR

SEQ ID NO: 503 - protein, 10 aa, Salmonella enteritidis
QNYALSHNGR

SEQ ID NO: 504 - protein, 10 aa, Salmonella enteritidis
QDRDSDSLDK

SEQ ID NO: 505 - protein, 9 aa, Salmonella enteritidis
YFMAVDYRF

SEQ ID NO: 506 - protein, 11 aa, Salmonella enteritidis
RPVQNLKDVLK

SEQ ID NO: 507 - protein, 11 aa, Salmonella enteritidis
LSLNYTYNDGR

SEQ ID NO: 508 - protein, 12 aa, Salmonella enteritidis
IFEPLALTTGIR

SEQ ID NO: 509 - protein, 11 aa, Salmonella enteritidis
DDYGYTEDGRR

SEQ ID NO: 510 - protein, 11 aa, Salmonella enteritidis
VPVFRYYNVNK

SEQ ID NO: 511 - protein, 14 aa, Salmonella enteritidis
EVPGVQLTNEGDNR

SEQ ID NO: 512 - protein, 15 aa, Salmonella enteritidis
GLDSSYTLILIDGKR

SEQ ID NO: 513 - protein, 15 aa, Salmonella enteritidis
EVPGVQLTNEGDNRK

SEQ ID NO: 514 - protein, 14 aa, Salmonella enteritidis
MDDHETYGDHWSPR

SEQ ID NO: 515 - protein, 15 aa, Salmonella enteritidis
WHGSVTVDSTIQEHR

SEQ ID NO: 516 - protein, 17 aa, Salmonella enteritidis
GEEGILEGVEASVTTFR

SEQ ID NO: 517 - protein, 16 aa, Salmonella enteritidis
HNDFDLNWIPVDAIER

SEQ ID NO: 518 - protein, 17 aa, Salmonella enteritidis
WHGSVTVDSTIQEHRDR

SEQ ID NO: 519 - protein, 19 aa, Salmonella enteritidis
QNYALSHNGRWDLGNSELK

SEQ ID NO: 520 - protein, 21 aa, Salmonella enteritidis
TPDVNAAPGYSNFVGFETNSR

SEQ ID NO: 521 - protein, 5 aa, Salmonella enteritidis
NDFTR

SEQ ID NO: 522 - protein, 7 aa, Salmonella enteritidis
VAFAGLK

SEQ ID NO: 523 - protein, 7 aa, Salmonella enteritidis
LYGNGDR

SEQ ID NO: 524 - protein, 8 aa, Salmonella enteritidis
GNGYATYR

SEQ ID NO: 525 - protein, 9 aa, Salmonella enteritidis
ATVYTGGLK

SEQ ID NO: 526 - protein, 10 aa, Salmonella enteritidis
DGNKLDLFGK

SEQ ID NO: 527 - protein, 9 aa, Salmonella enteritidis
NMSTYVDYK

SEQ ID NO: 528 - protein, 10 aa, Salmonella enteritidis
GSDGDQTYMR

SEQ ID NO: 529 - protein, 11 aa, Salmonella enteritidis
TADQNNTANAR

SEQ ID NO: 530 - protein, 11 aa, Salmonella enteritidis
FADAGSFDYGR

SEQ ID NO: 531 - protein, 11 aa, Salmonella enteritidis
INLLDKNDFTR

SEQ ID NO: 532 - protein, 12 aa, Salmonella enteritidis
YVDVGATYYFNK

SEQ ID NO: 533 - protein, 17 aa, Salmonella enteritidis
DISNGYGASYGDQDIVK

SEQ ID NO: 534 - protein, 18 aa, Salmonella enteritidis
FGTSNGSNPSTSYGFANK

SEQ ID NO: 535 - protein, 19 aa, Salmonella enteritidis
GKDISNGYGASYGDQDIVK

SEQ ID NO: 536 - protein, 20 aa, Salmonella enteritidis
NTDFFGLVDGLDFALQYQGK

SEQ ID NO: 537 - protein, 20 aa, Salmonella enteritidis
YDANNIYLAAQYSQTYNATR

SEQ ID NO: 538 - protein, 21 aa, Salmonella enteritidis
VDGLHYFSDDKGSDGDQTYMR

SEQ ID NO: 539 - protein, 26 aa, Salmonella enteritidis
AQNFEVVAQYQFDFGLRPSVAYLQSK

SEQ ID NO: 540 - protein, 32 aa, Salmonella enteritidis; identical to SEQ ID NO: 181

SEQ ID NO: 541 - protein, 7 aa, Salmonella enteritidis
LAFAGLK

SEQ ID NO: 542 - protein, 8 aa, Salmonella enteritidis
TTGVATYR

SEQ ID NO: 543 - protein, 10 aa, Salmonella enteritidis
NAEVWAAGLK

SEQ ID NO: 544 - protein, 9 aa, Salmonella enteritidis
NMSTFVDYK

SEQ ID NO: 545 - protein, 10 aa, Salmonella enteritidis
DGNKLDLYGK

SEQ ID NO: 546 - protein, 11 aa, Salmonella enteritidis
GNRTESQGADK

SEQ ID NO: 547 - protein, 11 aa, Salmonella enteritidis
INLLDDSDFTK

SEQ ID NO: 548 - protein, 11 aa, Salmonella enteritidis
FADYGSFDYGR

SEQ ID NO: 549 - protein, 20 aa, Salmonella enteritidis
NTDFFGLVEGLNFAAQYQGK

SEQ ID NO: 550 - protein, 21 aa, Salmonella enteritidis
VHAQHYFSDDNGSDGDKTYAR

SEQ ID NO: 551 - protein, 20 aa, Salmonella enteritidis
GETQINDQLTGFGQWEYEFK

SEQ ID NO: 552 - protein, 24 aa, Salmonella enteritidis
NLGTYGDQDLVEYIDVGATYYFNK

SEQ ID NO: 553 - protein, 24 aa, Salmonella enteritidis
TQNFEAVAQYQFDFGLRPSIAYLK

SEQ ID NO: 554 - protein, 33 aa, Salmonella enteritidis; identical to SEQ ID NO: 164

SEQ ID NO: 555 - protein, 5 aa, Salmonella enteritidis
HFTLK

SEQ ID NO: 556 - protein, 7 aa, Salmonella enteritidis
LGGMVWR

SEQ ID NO: 557 - protein, 7 aa, Salmonella enteritidis
RVEIEVK

SEQ ID NO: 558 - protein, 9 aa, Salmonella enteritidis
AQGVQLTAK

SEQ ID NO: 559 - protein, 10 aa, Salmonella enteritidis
SNVPGGPSTK

SEQ ID NO: 560 - protein, 9 aa, Salmonella enteritidis
DNTWYAGAK

SEQ ID NO: 561 - protein, 10 aa, Salmonella enteritidis
GIPSDKISAR

SEQ ID NO: 562 - protein, 9 aa, Salmonella enteritidis
SDVLFNFNK

SEQ ID NO: 563 - protein, 11 aa, Salmonella enteritidis
GVKDVVTQPQA

SEQ ID NO: 564 - protein, 11 aa, Salmonella enteritidis
AQSVVDYLISK

SEQ ID NO: 565 - protein, 12 aa, Salmonella enteritidis
DGSVVVLGFTDR

SEQ ID NO: 566 - protein, 12 aa, Salmonella enteritidis
RAQSVVDYLISK

SEQ ID NO: 567 - protein, 13 aa, Salmonella enteritidis
IGSDAYNQGLSEK

SEQ ID NO: 568 - protein, 13 aa, Salmonella enteritidis
MPYKGDNINGAYK

SEQ ID NO: 569 - protein, 13 aa, Salmonella enteritidis
MPYKGDNINGAYK

SEQ ID NO: 570 - protein, 14 aa, Salmonella enteritidis
IGSDAYNQGLSEKR

SEQ ID NO: 571 - protein, 14 aa, Salmonella enteritidis
LGYPITDDLDVYTR

SEQ ID NO: 572 - protein, 14 aa, Salmonella enteritidis
HFTLKSDVLFNFNK

SEQ ID NO: 573 - protein, 23 aa, Salmonella enteritidis
FGQQEAAPVVAPAPAPAPEVQTK

SEQ ID NO: 574 - protein, 25 aa, Salmonella enteritidis
DHDTGVSPVFAGGIEYAITPEIATR

SEQ ID NO: 575 - protein, 25 aa, Salmonella enteritidis
DGSVVVLGFTDRIGSDAYNQGLSEK

SEQ ID NO: 576 - protein, 24 aa, Salmonella enteritidis
STLKPEGQQALDQLYSQLSNLDPK

SEQ ID NO: 577 - protein, 31 aa, Salmonella enteritidis; identical to SEQ ID NO: 196

SEQ ID NO: 578 - protein, 35 aa, Salmonella enteritidis
SNVPGGPSTKDHDTGVSPVFAGGIEYAITPEIATR

SEQ ID NO: 579 - protein, 10 aa, Salmonella enteritidis
IEAGTVPLQR

SEQ ID NO: 580 - protein, 12 aa, Salmonella enteritidis
TGSYADTLPAGR

SEQ ID NO: 581 - protein, 10 aa, Salmonella enteritidis
TWYMSINTHF

SEQ ID NO: 582 - protein, 11 aa, Salmonella enteritidis
TDVYQWENVPK

SEQ ID NO: 583 - protein, 13 aa, Salmonella enteritidis
GDTAWVPPEMIER

SEQ ID NO: 584 - protein, 11 aa, Escherichia coli
FGDYGSIDYGR

SEQ ID NO: 585 - protein, 16 aa, Salmonella enteritidis
MPEGLAGGTEGIFDPK

SEQ ID NO: 586 - protein, 16 aa, Salmonella enteritidis
TNFSLNGPLGGDFSFR

SEQ ID NO: 587 - protein, 16 aa, Salmonella enteritidis
APSLYQTNPNYILYSK

SEQ ID NO: 588 - protein, 21 aa, Salmonella enteritidis
GPAAARYGNGAAGGVVNIITK

SEQ ID NO: 589 - protein, 17 aa, Salmonella enteritidis
WDFAPLQSLELEAGYSR

SEQ ID NO: 590 - protein, 19 aa, Salmonella enteritidis
GMGPENTLILIDGKPVTSR

SEQ ID NO: 591 - protein, 12 aa, Escherichia coli
YVDVGATYYFNK

SEQ ID NO: 592 - protein, 18 aa, Salmonella enteritidis
LSIIPQYTLNSTLSWQVR

SEQ ID NO: 593 - protein, 21 aa, Salmonella enteritidis
DTQTGAYMAGAGAYTYNEPGR

SEQ ID NO: 594 - protein, 19 aa, Salmonella enteritidis
GGSEWHGSWNTYFNAPEHK

SEQ ID NO: 595 - protein, 17 aa, Escherichia coli
HYFSSNDADDGDTTYAR

SEQ ID NO: 596 - protein, 20 aa, Salmonella enteritidis
KGGSEWHGSWNTYFNAPEHK

SEQ ID NO: 597 - protein, 4 aa, Salmonella enteritidis
YSWR

SEQ ID NO: 598 - protein, 5 aa, Salmonella enteritidis
IEVIR

SEQ ID NO: 599 - protein, 7 aa, Salmonella enteritidis
LYGNLNR

SEQ ID NO: 600 - protein, 7 aa, Salmonella enteritidis
LGFYYEK

SEQ ID NO: 601 - protein, 10 aa, Salmonella enteritidis
IVAGDQIIGR

SEQ ID NO: 602 - protein, 10 aa, Salmonella enteritidis
QQPGVSIITR

SEQ ID NO: 603 - protein, 11 aa, Salmonella enteritidis
LNVGISNIFDK

SEQ ID NO: 604 - protein, 11 aa, Salmonella enteritidis
ITNDQTFTTNR

SEQ ID NO: 605 - protein, 12 aa, Salmonella enteritidis
NPPVNDLADIIR

SEQ ID NO: 606 - protein, 14 aa, Salmonella enteritidis
DSNIAGIPGSAANR

SEQ ID NO: 607 - protein, 13 aa, Salmonella enteritidis
SAEGANTYNEPGR

SEQ ID NO: 608 - protein, 13 aa, Salmonella enteritidis
GDTNWVPPEMVER

SEQ ID NO: 609 - protein, 15 aa, Salmonella enteritidis
SASGAYVLQWQNGGK

SEQ ID NO: 610 - protein, 17 aa, Salmonella enteritidis
GNFSLSGPLAGDTLTMR

SEQ ID NO: 611 - protein, 15 aa, Salmonella enteritidis
EGVTNKDINSVFSWR

SEQ ID NO: 612 - protein, 16 aa, Salmonella enteritidis
APNLYQTSEGYLLYSK

SEQ ID NO: 613 - protein, 18 aa, Salmonella enteritidis
ALGAYSLVGANVNYDINK

SEQ ID NO: 614 - protein, 18 aa, Salmonella enteritidis
ALIEGIEASMAVPLMPDR

SEQ ID NO: 615 - protein, 19 aa, Salmonella enteritidis
EIGLEFTVDDYHASVTYFR

SEQ ID NO: 616 - protein, 21 aa, Salmonella enteritidis
RPTNDWHGSLSLYTNQPESSK

SEQ ID NO: 617 - protein, 25 aa, Salmonella enteritidis
SEISALYVEDNIEPMAGTNIIPGLR

SEQ ID NO: 618 - protein, 26 aa, Salmonella enteritidis
FDYLSESGSNFSPSLNLSQELGEYVK

SEQ ID NO: 619 - protein, 5 aa, Salmonella enteritidis
NAVFR

SEQ ID NO: 620 - protein, 5 aa, Salmonella enteritidis
VPVFR

SEQ ID NO: 621 - protein, 8 aa, Salmonella enteritidis
VPFNEAWK

SEQ ID NO: 622 - protein, 8 aa, Salmonella enteritidis
YFMAVDYR

SEQ ID NO: 623 - protein, 10 aa, Salmonella enteritidis
QDRDSDSLDK

SEQ ID NO: 624 - protein, 11 aa, Salmonella enteritidis
LSLNYTYNDGR

SEQ ID NO: 625 - protein, 12 aa, Salmonella enteritidis
IFEPLALTTGIR

SEQ ID NO: 626 - protein, 14 aa, Salmonella enteritidis
EVPGVQLTNEGDNR

SEQ ID NO: 627 - protein, 15 aa, Salmonella enteritidis
GLDSSYTLILIDGKR

SEQ ID NO: 628 - protein, 16 aa, Salmonella enteritidis
DAPASISVITQQDLQR

SEQ ID NO: 629 - protein, 14 aa, Salmonella enteritidis
MDDHETYGDHWSPR

SEQ ID NO: 630 - protein, 15 aa, Salmonella enteritidis
WHGSVTVDSTIQEHR

SEQ ID NO: 631 - protein, 17 aa, Salmonella enteritidis
GEEGILEGVEASVTTFR

SEQ ID NO: 632 - protein, 15 aa, Salmonella enteritidis
TSASQYALFLEDEWR

SEQ ID NO: 633 - protein, 18 aa, Salmonella enteritidis
TPGGYVVWDTGAAWQATK

SEQ ID NO: 634 - protein, 18 aa, Salmonella enteritidis
EKDEQQSSATTATGETPR

SEQ ID NO: 635 - protein, 16 aa, Salmonella enteritidis
HNDFDLNWIPVDAIER

SEQ ID NO: 636 - protein, 19 aa, Salmonella enteritidis
YVLPLASVNQFLTFGGEWR

SEQ ID NO: 637 - protein, 21 aa, Salmonella enteritidis
TPDVNAAPGYSNFVGFETNSR

SEQ ID NO: 638 - protein, 25 aa, Salmonella enteritidis
ADSATAKTPGGYVVWDTGAAWQATK

SEQ ID NO: 639 - protein, 24 aa, Salmonella enteritidis
DRGDTYNGQFFTSGPLIDGVLGMK

SEQ ID NO: 640 - protein, 24 aa, Salmonella enteritidis
DGNVEFAWTPNENHDVTAGYGFDR

SEQ ID NO: 641 - protein, 6 aa, Salmonella enteritidis
LSSGLR

SEQ ID NO: 642 - protein, 9 aa, Salmonella enteritidis
SSLGAIQNR

SEQ ID NO: 643 - protein, 11 aa, Salmonella enteritidis
DDAAGQAIANR

SEQ ID NO: 644 - protein, 9 aa, Salmonella enteritidis
SIQDEIQQR

SEQ ID NO: 645 - protein, 11 aa, Salmonella enteritidis
SQSSLSSAIER

SEQ ID NO: 646 - protein, 13 aa, Salmonella enteritidis
SLGLDGFNVNGPK

SEQ ID NO: 647 - protein, 15 aa, Salmonella enteritidis
STANPLASIDSALSK

SEQ ID NO: 648 - protein, 16 aa, Salmonella enteritidis
NVTGYDTYAAGADKYR

SEQ ID NO: 649 - protein, 16 aa, Salmonella enteritidis
NVYTSVVNGQFTFDDK

SEQ ID NO: 650 - protein, 19 aa, Salmonella enteritidis
FDSAITNLGNTVTNLNSAR

SEQ ID NO: 651 - protein, 19 aa, Salmonella enteritidis
AQVINTNSLSLLTQNNLNK

SEQ ID NO: 652 - protein, 25 aa, Salmonella enteritidis
NANDGISIAQTTEGALNEINNNLQR

SEQ ID NO: 653 - protein, 25 aa, Salmonella enteritidis
VYVNAANGQLTTDDAENNTAVDLFK

SEQ ID NO: 654 - protein, 27 aa, Salmonella enteritidis
AQILQQAGTSVLAQANQVPQNVLSLLR

SEQ ID NO: 655 - protein, 8 aa, Salmonella enteritidis
NLSLLQAR

SEQ ID NO: 656 - protein, 8 aa, Salmonella enteritidis
QLDQTTQR

SEQ ID NO: 657 - protein, 11 aa, Salmonella enteritidis
NNLDNAVEELR

SEQ ID NO: 658 - protein, 11 aa, Salmonella enteritidis
YTYLINQLNIK

SEQ ID NO: 659 - protein, 14 aa, Salmonella enteritidis
AQYDTVLANEVTAR

SEQ ID NO: 660-669 - skipped (10 entries)

SEQ ID NO: 670 - protein, 15 aa, Salmonella enteritidis
FNVGLVAITDVQNAR

SEQ ID NO: 671 - protein, 15 aa, Salmonella enteritidis
VLNAIDVLSYTQAQK

SEQ ID NO: 672 - protein, 16 aa, Salmonella enteritidis
TIVDVLDATTTLYDAK

SEQ ID NO: 673 - protein, 17 aa, Salmonella enteritidis
SSFNNINASISSINAYK

SEQ ID NO: 674 - protein, 18 aa, Salmonella enteritidis
QAQYNFVGASEQLESAHR

SEQ ID NO: 675 - protein, 20 aa, Salmonella enteritidis
SPLLPQLGLGADYTYSNGYR

SEQ ID NO: 676 - protein, 19 aa, Salmonella enteritidis
QVTGNYYPELASLNVEHFK

SEQ ID NO: 677 - protein, 9 aa, Salmonella enteritidis
SSLGAIQNR

SEQ ID NO: 678 - protein, 9 aa, Salmonella enteritidis
SIQDEIQQR

SEQ ID NO: 679 - protein, 11 aa, Salmonella enteritidis
VSNQTQFNGVK

SEQ ID NO: 680 - protein, 13 aa, Salmonella enteritidis
SLGLDGFNVNGPK

SEQ ID NO: 681 - protein, 14 aa, Salmonella enteritidis
NVTGYDTYAAGADK

SEQ ID NO: 682 - protein, 15 aa, Salmonella enteritidis
STANPLASIDSALSK

SEQ ID NO: 683 - protein, 17 aa, Salmonella enteritidis
IQVGANDGETITIDLQK

SEQ ID NO: 684 - protein, 16 aa, Salmonella enteritidis
NVYTSVVNGQFTFDDK

SEQ ID NO: 685 - protein, 19 aa, Salmonella enteritidis
FDSAITNLGNTVTNLNSAR

SEQ ID NO: 686 - protein, 25 aa, Salmonella enteritidis
NANDGISIAQTTEGALNEINNNLQR

SEQ ID NO: 687 - protein, 25 aa, Salmonella enteritidis
VYVNAANGQLTTDDAENNTAVDLFK

SEQ ID NO: 688 - protein, 26 aa, Salmonella enteritidis
AQILQQAGTSVLAQANQVPQNVLSLL

SEQ ID NO: 689 - protein, 10 aa, Salmonella enteritidis
ELVNMIVAQR

SEQ ID NO: 690 - protein, 19 aa, Escherichia coli
TDTQVNAGKVLPEVFASGK

SEQ ID NO: 691 - protein, 12 aa, Salmonella enteritidis
LVDSNGSVFYSR

SEQ ID NO: 692 - protein, 14 aa, Salmonella enteritidis
SGTASFADMFAGSK

SEQ ID NO: 693 - protein, 20 aa, Escherichia coli
NNDFFGLVDGLNFAAQYQGK

SEQ ID NO: 694 - protein, 13 aa, Salmonella enteritidis
GLDVAISQNGFFR

SEQ ID NO: 695 - protein, 13 aa, Salmonella enteritidis
TQDQILNTLVNLR

SEQ ID NO: 696 - protein, 18 aa, Salmonella enteritidis
VAGITQDFTDGTTTNTGR

SEQ ID NO: 697 - protein, 21 aa, Salmonella enteritidis
GTVTVYDSQGNAHDMNVYFVK

SEQ ID NO: 698 - protein, 20 aa, Escherichia coli
GETQINDQLTGFGQWEYEFK

SEQ ID NO: 699 - protein, 29 aa, Salmonella enteritidis
TKDNEWAVYTHDSSDPAATAPTTASTTLK

SEQ ID NO: 700 - protein, 11 aa, Salmonella enteritidis
FADAGSFDYGR

SEQ ID NO: 701 - protein, 11 aa, Salmonella enteritidis
INLLDKNDFTR

SEQ ID NO: 702 - protein, 12 aa, Salmonella enteritidis
YVDVGATYYFNK

SEQ ID NO: 703 - protein, 17 aa, Salmonella enteritidis
DISNGYGASYGDQDIVK

SEQ ID NO: 704 - protein, 18 aa, Salmonella enteritidis
FGTSNGSNPSTSYGFANK

SEQ ID NO: 705 - protein, 20 aa, Salmonella enteritidis
NTDFFGLVDGLDFALQYQGK

SEQ ID NO: 706 - protein, 20 aa, Salmonella enteritidis
YDANNIYLAAQYSQTYNATR

SEQ ID NO: 707 - protein, 21 aa, Salmonella enteritidis
VDGLHYFSDDKGSDGDQTYMR

SEQ ID NO: 708 - protein, 26 aa, Salmonella enteritidis
AQNFEVVAQYQFDFGLRPSVAYLQSK

SEQ ID NO: 709 - protein, 7 aa, Salmonella enteritidis
LGGMVWR

SEQ ID NO: 710 - protein, 12 aa, Salmonella enteritidis
DGSVVVLGFTDR

SEQ ID NO: 711 - protein, 14 aa, Salmonella enteritidis
LGYPITDDLDVYTR

SEQ ID NO: 712 - protein, 23 aa, Salmonella enteritidis
FGQQEAAPVVAPAPAPAPEVQTK

SEQ ID NO: 713 - protein, 25 aa, Salmonella enteritidis
DHDTGVSPVFAGGIEYAITPEIATR

SEQ ID NO: 714 - protein, 24 aa, Salmonella enteritidis
STLKPEGQQALDQLYSQLSNLDPK

SEQ ID NO: 715 - protein, 31 aa, Salmonella enteritidis; identical to SEQ ID NO: 196

SEQ ID NO: 716 - protein, 5 aa, Escherichia coli
IEVLR

SEQ ID NO: 717 - protein, 7 aa, Escherichia coli
DINGVVR

SEQ ID NO: 718 - protein, 7 aa, Escherichia coli
DVSEIIR

SEQ ID NO: 719 - protein, 8 aa, Escherichia coli
EIGLEFKR

SEQ ID NO: 720 - protein, 12 aa, Escherichia coli
AGTYATTLPAGR

SEQ ID NO: 721 - protein, 10 aa, Escherichia coli
TWYMSVNTHF

SEQ ID NO: 722 - protein, 11 aa, Escherichia coli
DGWLAGITWFR

SEQ ID NO: 723 - protein, 12 aa, Escherichia coli
NPVARDVSEIIR

SEQ ID NO: 724 - protein, 15 aa, Escherichia coli
YGNGAAGGVVNIITK

SEQ ID NO: 725 - protein, 13 aa, Escherichia coli
GDTSWVPPEMIER

SEQ ID NO: 726 - protein, 16 aa, Escherichia coli
TMPGVNLTGNSTSGQR

SEQ ID NO: 727 - protein, 15 aa, Escherichia coli
NVSLTGGVDNLFDKR

SEQ ID NO: 728 - protein, 14 aa, Escherichia coli
EDLSMQTTFTWYGK

SEQ ID NO: 729 - protein, 16 aa, Escherichia coli
TNFSLTGPLGDEFSFR

SEQ ID NO: 730 - protein, 16 aa, Escherichia coli
TQADAWDINQGHQSAR

SEQ ID NO: 731 - protein, 16 aa, Escherichia coli
APSLYQTNPNYILYSK

SEQ ID NO: 732 - protein, 18 aa, Escherichia coli
EISPYSIVGLSATWDVTK

SEQ ID NO: 733 - protein, 17 aa, Escherichia coli
WDFAPLQSLELEAGYSR

SEQ ID NO: 734 - protein, 19 aa, Escherichia coli
QGNLYAGDTQNTNSDAYTR

SEQ ID NO: 735 - protein, 19 aa, Escherichia coli
GSGEWHGSWDAYFNAPEHK

SEQ ID NO: 736 - protein, 20 aa, Escherichia coli
KGSGEWHGSWDAYFNAPEHK

SEQ ID NO: 737 - protein, 23 aa, Escherichia coli
LYGNLDKTQADAWDINQGHQSAR

SEQ ID NO: 738 - protein, 25 aa, Escherichia coli
IEAGYVAVGQNAVGTDLYQWDNVPK

SEQ ID NO: 739 - protein, 29 aa, Escherichia coli
AGNAQTTGDLAGANYIAGAGAYTYNEPGR

SEQ ID NO: 740 - protein, 28 aa, Escherichia coli
FDHHSIVGNNWSPALNISQGLGDDFTLK

SEQ ID NO: 741 - protein, 27 aa, Escherichia coli
QNYSLTWNGGWDNGVTTSNWVQYEHTR

SEQ ID NO: 742 - protein, 9 aa, Escherichia coli
DPANSGPYR

SEQ ID NO: 743 - protein, 9 aa, Escherichia coli
QVVATATFR

SEQ ID NO: 744 - protein, 8 aa, Escherichia coli
DDKQFTWR

SEQ ID NO: 745 - protein, 11 aa, Escherichia coli
RLPTDFNEGAK

SEQ ID NO: 746 - protein, 12 aa, Escherichia coli
VGSYTVVDALVR

SEQ ID NO: 747 - protein, 12 aa, Escherichia coli
GASNTYDHLIIR

SEQ ID NO: 748 - protein, 11 aa, Escherichia coli
YDWADQESLNR

SEQ ID NO: 749 - protein, 14 aa, Escherichia coli
EALSYTPGVSVGTR

SEQ ID NO: 750 - protein, 14 aa, Escherichia coli
YTGSSYGDPANSFK

SEQ ID NO: 751 - protein, 13 aa, Escherichia coli
RPTTEPLKEVQFK

SEQ ID NO: 752 - protein, 14 aa, Escherichia coli
YAIAPAFTWRPDDK

SEQ ID NO: 753 - protein, 14 aa, Escherichia coli
QTGVYVQDQAQWDK

SEQ ID NO: 754 - protein, 17 aa, Escherichia coli
GFAAEGQSQNNYLNGLK

SEQ ID NO: 755 - protein, 18 aa, Escherichia coli
VGMAGSNVALHVNNLFDR

SEQ ID NO: 756 - protein, 19 aa, Escherichia coli
YVPEDRPIVVTGAVYNLTK

SEQ ID NO: 757 - protein, 21 aa, Escherichia coli
TSQNSVYGYGVCSDPANAYSK

SEQ ID NO: 758 - protein, 21 aa, Escherichia coli
TNNLMADPEGSFFSVEGGEIR

SEQ ID NO: 759 - protein, 6 aa, Escherichia coli
TLRYER

SEQ ID NO: 760 - protein, 8 aa, Escherichia coli
WGLAGQPR

SEQ ID NO: 761 - protein, 9 aa, Escherichia coli
SEQRDGDNK

SEQ ID NO: 762 - protein, 10 aa, Escherichia coli
DKWGLAGQPR

SEQ ID NO: 763 - protein, 13 aa, Escherichia coli
DGQLGSLTGGYDR

SEQ ID NO: 764 - protein, 13 aa, Escherichia coli
DGVVLASTGETFR

SEQ ID NO: 765 - protein, 11 aa, Escherichia coli
SYLNWNETENK

SEQ ID NO: 766 - protein, 13 aa, Escherichia coli
FTQNYSSLSAVQK

SEQ ID NO: 767 - protein, 15 aa, Escherichia coli
GMPASYTLILIDGVR

SEQ ID NO: 768 - protein, 14 aa, Escherichia coli
AYLVWDVADAWTLK

SEQ ID NO: 769 - protein, 15 aa, Escherichia coli
IPYPTESQNYNLGAR

SEQ ID NO: 770 - protein, 14 aa, Escherichia coli
YEHHEQFGGHFSPR

SEQ ID NO: 771 - protein, 16 aa, Escherichia coli
WLSSVNAGLNLQESNK

SEQ ID NO: 772 - protein, 15 aa, Escherichia coli
ASEQDVLWFDMDTTR

SEQ ID NO: 773 - protein, 26 aa, Escherichia coli
AQNFEAVAQYQFDFGLRPSVAYLQSK

SEQ ID NO: 774 - protein, 22 aa, Escherichia coli
GPMSTLYGSDAMGGVVNIITRK

SEQ ID NO: 775 - protein, 23 aa, Escherichia coli
STLYAGDYFQTGSSTTGYVIPER

SEQ ID NO: 776 - protein, 6 aa, Escherichia coli
HFSIGR

SEQ ID NO: 777 - protein, 7 aa, Escherichia coli
IYWSEVR

SEQ ID NO: 778 - protein, 9 aa, Escherichia coli
IWGWDVMTK

SEQ ID NO: 779 - protein, 11 aa, Escherichia coli
DLPITLLGGTR

SEQ ID NO: 780 - protein, 10 aa, Escherichia coli
MSRPQFTSLR

SEQ ID NO: 781 - protein, 12 aa, Escherichia coli
DLLQEGQSSGFR

SEQ ID NO: 782 - protein, 13 aa, Escherichia coli
INAQNTGSSGEYR

SEQ ID NO: 783 - protein, 13 aa, Escherichia coli
TENLDGIVAWSSR

SEQ ID NO: 784 - protein, 14 aa, Escherichia coli
LAPQGNDWLNADAK

SEQ ID NO: 785 - protein, 13 aa, Escherichia coli
EYWSPQGIPQDGR

SEQ ID NO: 786 - protein, 16 aa, Escherichia coli
QEQHPGGATTGFPQAK

SEQ ID NO: 787 - protein, 14 aa, Escherichia coli
FDDLMLSNDALEFK

SEQ ID NO: 788 - protein, 14 aa, Escherichia coli
YTTDLFSLDVAYNR

SEQ ID NO: 789 - protein, 16 aa, Escherichia coli
GTWQIDSAQSLSGLVR

SEQ ID NO: 790 - protein, 15 aa, Escherichia coli
IDFSSGWLQDEITLR

SEQ ID NO: 791 - protein, 17 aa, Escherichia coli
NPQTVEASESSNPMVDR

SEQ ID NO: 792 - protein, 21 aa, Escherichia coli
VFGTGGTGDHSLGLGASAFGR

SEQ ID NO: 793 - protein, 20 aa, Escherichia coli
QPGYGVNDFYVSYQGQQALK

SEQ ID NO: 794 - protein, 21 aa, Escherichia coli
STLFADSFASHLLTYGGEYYR

SEQ ID NO: 795 - protein, 6 aa, Escherichia coli
LSSGLR

SEQ ID NO: 796 - protein, 9 aa, Escherichia coli
SSLGAIQNR

SEQ ID NO: 797 - protein, 11 aa, Escherichia coli
NQSALSSSIER

SEQ ID NO: 798 - protein, 11 aa, Escherichia coli
LNTTTGLYDLK

SEQ ID NO: 799 - protein, 14 aa, Escherichia coli
AQIIQQAGNSVLAK

SEQ ID NO: 800 - protein, 15 aa, Escherichia coli
VSGQTQFNGVNVLAK

SEQ ID NO: 801 - protein, 17 aa, Escherichia coli
DYAPAIGTAVNVNSAGK

SEQ ID NO: 802 - protein, 17 aa, Escherichia coli
KIDSDTLGLNGFNVNGK

SEQ ID NO: 803 - protein, 20 aa, Escherichia coli
TIGFTAGESSDAAKSYVDDK

SEQ ID NO: 804 - protein, 19 aa, Escherichia coli
AQVINTNSLSLITQNNINK

SEQ ID NO: 805 - protein, 22 aa, Escherichia coli
AASEGSDGASLTFNGTEYTIAK

SEQ ID NO: 806 - protein, 21 aa, Escherichia coli
LDSAVTNLNNTTTNLSEAQSR

SEQ ID NO: 807 - protein, 25 aa, Escherichia coli
ATPATTTPVAPLIPGGITYQATVSK

SEQ ID NO: 808 - protein, 25 aa, Escherichia coli
NANDGISVAQTTEGALSEINNNLQR

SEQ ID NO: 809 - protein, 5 aa, Escherichia coli
VEYIR

SEQ ID NO: 810 - protein, 11 aa, Escherichia coli
LYSQSWDAGLR

SEQ ID NO: 811 - protein, 10 aa, Escherichia coli
DYNYDPHYGR

SEQ ID NO: 812 - protein, 11 aa, Escherichia coli
WQSTSVNDVLR

SEQ ID NO: 813 - protein, 12 aa, Escherichia coli
KLYSQSWDAGLR

SEQ ID NO: 814 - protein, 15 aa, Escherichia coli
GTNASHVLVLIDGVR

SEQ ID NO: 815 - protein, 16 aa, Escherichia coli
QWEGAFEGLTAGVNWR

SEQ ID NO: 816 - protein, 19 aa, Escherichia coli
SAVYGSDAIGGVVNIITTR

SEQ ID NO: 817 - protein, 17 aa, Escherichia coli
TNYDAYYSPGSPLVDTR

SEQ ID NO: 818 - protein, 21 aa, Escherichia coli
LPGVDITQNGGSGQLSSIFIR

SEQ ID NO: 819 - protein, 20 aa, Escherichia coli
IANLFDKDYETVYGYQTAGR

SEQ ID NO: 820 - protein, 22 aa, Escherichia coli
NTGIYLTGLQQVGDFTFEGAAR

SEQ ID NO: 821 - protein, 25 aa, Escherichia coli
GVEATANFDTGPLTHTVSYDYVDAR

SEQ ID NO: 822 - protein, 11 aa, Escherichia coli
NNLDNAVEQLR

SEQ ID NO: 823 - protein, 11 aa, Escherichia coli
YNYLINQLNIK

SEQ ID NO: 824 - protein, 14 aa, Escherichia coli
AQYDTVLANEVTAR

SEQ ID NO: 825 - protein, 15 aa, Escherichia coli
FNVGLVAITDVQNAR

SEQ ID NO: 826 - protein, 17 aa, Escherichia coli
SSFNNINASISSINAYK

SEQ ID NO: 827 - protein, 18 aa, Escherichia coli
QAQYNFVGASEQLESAHR

SEQ ID NO: 828 - protein, 20 aa, Escherichia coli
VGLSFSLPIYQGGMVNSQVK

SEQ ID NO: 829 - protein, 19 aa, Escherichia coli
QITGNYYPELAALNVENFK

SEQ ID NO: 830 - protein, 22 aa, Escherichia coli
QAVVSAQSSLDAMEAGYSVGTR

SEQ ID NO: 831 - protein, 7 aa, Escherichia coli
VAFAGLK

SEQ ID NO: 832 - protein, 8 aa, Escherichia coli
GNGFATYR

SEQ ID NO: 833 - protein, 9 aa, Escherichia coli
VGSLGWANK

SEQ ID NO: 834 - protein, 9 aa, Escherichia coli
AETYTGGLK

SEQ ID NO: 835 - protein, 9 aa, Escherichia coli
NMSTYVDYK

SEQ ID NO: 836 - protein, 10 aa, df
DGNKLDLYGK

SEQ ID NO: 837 - protein, 9 aa, g
NYDDEDILK

SEQ ID NO: 838 - protein, 10 aa, Escherichia coli
SVDGDQTYMR

SEQ ID NO: 839 - protein, 11 aa, Escherichia coli
FQDVGSFDYGR

SEQ ID NO: 840 - protein, 11 aa, Escherichia coli
INLLDDNQFTR

SEQ ID NO: 841 - protein, 14 aa, Escherichia coli
NGSVSGEGMTNNGR

SEQ ID NO: 842 - protein, 14 aa, Escherichia coli
NGSVSGEGMTNNGR

SEQ ID NO: 843 - protein, 12 aa, Escherichia coli
YVDVGATYYFNK

SEQ ID NO: 844 - protein, 15 aa, Escherichia coli
TDDQNSPLYIGNGDR

SEQ ID NO: 845 - protein, 16 aa, Escherichia coli
RTDDQNSPLYIGNGDR

SEQ ID NO: 846 - protein, 16 aa, Escherichia coli
RTDDQNSPLYIGNGDR

SEQ ID NO: 847 - protein, 20 aa, Escherichia coli
NTDFFGLVDGLNFAVQYQGK

SEQ ID NO: 848 - protein, 20 aa, Escherichia coli
YDANNIYLAAQYTQTYNATR

SEQ ID NO: 849 - protein, 21 aa, Escherichia coli
VDGLHYFSDDKSVDGDQTYMR

SEQ ID NO: 850 - protein, 24 aa, Escherichia coli
TDDQNSPLYIGNGDRAETYTGGLK

SEQ ID NO: 851 - protein, 28 aa, Escherichia coli
QNGDGVGGSITYDYEGFGIGAAVSSSKR

SEQ ID NO: 852 - protein, 26 aa, Escherichia coli
AQNFEAVAQYQFDFGLRPSLAYLQSK

SEQ ID NO: 853 - protein, 31 aa, Escherichia coli
EALRQNGDGVGGSITYDYEGFGIGAAVSSSK

SEQ ID NO: 854 - protein, 7 aa, Escherichia coli
LGGMVWR

SEQ ID NO: 855 - protein, 9 aa, Escherichia coli
AQGVQLTAK

SEQ ID NO: 856 - protein, 10 aa, Escherichia coli
GIPADKISAR

SEQ ID NO: 857 - protein, 9 aa, Escherichia coli
DNTWYTGAK

SEQ ID NO: 858 - protein, 9 aa, Escherichia coli
SDVLFNFNK

SEQ ID NO: 859 - protein, 11 aa, Escherichia coli
GIKDVVTQPQA

SEQ ID NO: 860 - protein, 11 aa, Escherichia coli
AQSVVDYLISK

SEQ ID NO: 861 - protein, 12 aa, Escherichia coli
DGSVVVLGYTDR

SEQ ID NO: 862 - protein, 12 aa, Escherichia coli
RAQSVVDYLISK

SEQ ID NO: 863 - protein, 13 aa, Escherichia coli
IGSDAYNQGLSER

SEQ ID NO: 864 - protein, 13 aa, Escherichia coli
MPYKGSVENGAYK

SEQ ID NO: 865 - protein, 14 aa, Escherichia coli
IGSDAYNQGLSERR

SEQ ID NO: 866 - protein, 14 aa, Escherichia coli
LGYPITDDLDIYTR

SEQ ID NO: 867 - protein, 14 aa, Escherichia coli
HFTLKSDVLFNFNK

SEQ ID NO: 868 - protein, 23 aa, Escherichia coli
FGQGEAAPVVAPAPAPAPEVQTK

SEQ ID NO: 869 - protein, 24 aa, Escherichia coli
ATLKPEGQAALDQLYSQLSNLDPK

SEQ ID NO: 870 - protein, 25 aa, Escherichia coli
NHDTGVSPVFAGGVEYAITPEIATR

SEQ ID NO: 871 - protein, 25 aa, Escherichia coli
DGSVVVLGYTDRIGSDAYNQGLSER

SEQ ID NO: 872 - protein, 31 aa, Escherichia coli; identical to SEQ ID NO: 179

SEQ ID NO: 873 - protein, 8 aa, Escherichia coli
ATNLLYTR

SEQ ID NO: 874 - protein, 9 aa, Escherichia coli
YAIVANDVR

SEQ ID NO: 875 - protein, 13 aa, Escherichia coli
TALIDHLDTMAER

SEQ ID NO: 876 - protein, 29 aa, Escherichia coli
YDANNIYLATTYSETQNMTVFADHFVANK

SEQ ID NO: 877 - protein, 13 aa, Escherichia coli
QVIQFIDLSLITK

SEQ ID NO: 878 - protein, 15 aa, Escherichia coli
GANFIAVHEMLDGFR

SEQ ID NO: 879 - protein, 33 aa, Escherichia coli
SDFDNYTEGNGDGFGFSATYEYEGFGIGATYAK

SEQ ID NO: 880 - protein, 7 aa, Escherichia coli
LVQLNYR

SEQ ID NO: 881 - protein, 8 aa, Escherichia coli
GGIQYDTR

SEQ ID NO: 882 - protein, 9 aa, Escherichia coli
IYDDAAVER

SEQ ID NO: 883 - protein, 10 aa, Escherichia coli
EAPGQPEPVR

SEQ ID NO: 884 - protein, 9 aa, Escherichia coli
AQYLYVPYR

SEQ ID NO: 885 - protein, 12 aa, Escherichia coli
YGSSTDGYATQK

SEQ ID NO: 886 - protein, 11 aa, Escherichia coli
EEQVAEIWNAR

SEQ ID NO: 887 - protein, 12 aa, Escherichia coli
IYGQAVHFVNTR

SEQ ID NO: 888 - protein, 11 aa, Escherichia coli
RGNIMWENEFR

SEQ ID NO: 889 - protein, 13 aa, Escherichia coli
YASPEYIQATLPK

SEQ ID NO: 890 - protein, 13 aa, Escherichia coli
TGSLVWAGDTYWR

SEQ ID NO: 891 - protein, 13 aa, Escherichia coli
VSDPSYFNDFDNK

SEQ ID NO: 892 - protein, 14 aa, Escherichia coli
LDNVATSNSSIEYR

SEQ ID NO: 893 - protein, 15 aa, Escherichia coli
GLSSNYGLGTQEMLR

SEQ ID NO: 894 - protein, 5 aa, Escherichia coli
HFTLK

SEQ ID NO: 895 - protein, 14 aa, Escherichia coli
DTNVWEGDYQMVGR

SEQ ID NO: 896 - protein, 7 aa, Escherichia coli
LGGMVWR

SEQ ID NO: 897 - protein, 17 aa, Escherichia coli
NGISQVGAVASWPIADR

SEQ ID NO: 898 - protein, 15 aa, Escherichia coli
FNISVGQIYYFTESR

SEQ ID NO: 899 - protein, 16 aa, Escherichia coli
QHAVYDNAIGFNIELR

SEQ ID NO: 900 - protein, 17 aa, Escherichia coli
LLATHYQQTNLDWYNSR

SEQ ID NO: 901 - protein, 18 aa, Escherichia coli
IYNYDSSLLQSDYSGLFR

SEQ ID NO: 902 - protein, 5 aa, Escherichia coli
IEVLR

SEQ ID NO: 903 - protein, 7 aa, Escherichia coli
DVSEIIR

SEQ ID NO: 904 - protein, 12 aa, Escherichia coli
AGTYATTLPAGR

SEQ ID NO: 905 - protein, 15 aa, Escherichia coli
NVSLTGGVDNLFDKR

SEQ ID NO: 906 - protein, 16 aa, Escherichia coli
TNFSLTGPLGDEFSFR

SEQ ID NO: 907 - protein, 16 aa, Escherichia coli
TQADAWDINQGHQSAR

SEQ ID NO: 908 - protein, 16 aa, Escherichia coli
APSLYQTNPNYILYSK

SEQ ID NO: 909 - protein, 17 aa, Escherichia coli
WDFAPLQSLELEAGYSR

SEQ ID NO: 910 - protein, 19 aa, Escherichia coli
QGNLYAGDTQNTNSDAYTR

SEQ ID NO: 911 - protein, 18 aa, Escherichia coli
LSIIPEYTLNSTLSWQAR

SEQ ID NO: 912 - protein, 19 aa, Escherichia coli
GSGEWHGSWDAYFNAPEHK

SEQ ID NO: 913 - protein, 20 aa, Escherichia coli
KGSGEWHGSWDAYFNAPEHK

SEQ ID NO: 914 - protein, 29 aa, Escherichia coli
AGNAQTTGDLAGANYIAGAGAYTYNEPGR

SEQ ID NO: 915 - protein, 13 aa, Escherichia coli
SSEGANTYNEPGR

SEQ ID NO: 916 - protein, 13 aa, Escherichia coli
GDTNWVPPEQVER

SEQ ID NO: 917 - protein, 17 aa, Escherichia coli
ANFSLSGPLAGNALTTR

SEQ ID NO: 918 - protein, 17 aa, Escherichia coli
TNNTRMNEGLSGGGEGR

SEQ ID NO: 919 - protein, 16 aa, Escherichia coli
APNLYQSSEGYLLYSK

SEQ ID NO: 920 - protein, 19 aa, Escherichia coli
IVAGDNVIGQTASGAYILK

SEQ ID NO: 921 - protein, 21 aa, Escherichia coli
GPAAARYGSGAAGGVVNIITK

SEQ ID NO: 922 - protein, 19 aa, Escherichia coli
GMGPENTLILIDGVPVTSR

SEQ ID NO: 923 - protein, 7 aa, Escherichia coli
RVEIEVK

SEQ ID NO: 924 - protein, 17 aa, Escherichia coli
QNYGITHNGIWDWGQSR

SEQ ID NO: 925 - protein, 24 aa, Escherichia coli
QNYGITHNGIWDWGQSRFGVYYEK

SEQ ID NO: 926 - protein, 27 aa, Escherichia coli
NHSQISALYIEDNIEPVPGTNIIPGLR

SEQ ID NO: 927 - protein, 5 aa, Escherichia coli
IEVIR

SEQ ID NO: 928 - protein, 6 aa, Escherichia coli
YWANVR

SEQ ID NO: 929 - protein, 7 aa, Escherichia coli
QIWAAQR

SEQ ID NO: 930 - protein, 7 aa, Escherichia coli
FVFEYGK

SEQ ID NO: 931 - protein, 13 aa, Escherichia coli
DKYNHWDLNYESR

SEQ ID NO: 932 - protein, 14 aa, Escherichia coli
LDNHEIYGSYWNPR

SEQ ID NO: 933 - protein, 17 aa, Escherichia coli
FGNSTTNDFYLSGPLIK

SEQ ID NO: 934 - protein, 19 aa, Escherichia coli
DVEGISITGGNEKPDISIR

SEQ ID NO: 935 - protein, 18 aa, Escherichia coli
SEDIDTIDGNWQVDEGRR

SEQ ID NO: 936 - protein, 21 aa, Escherichia coli
EVSPGFGTLTQGGASIMYGNR

SEQ ID NO: 937 - protein, 20 aa, Escherichia coli
DPVTGLNTFIYDNVGEANIR

SEQ ID NO: 938 - protein, 23 aa, Escherichia coli
ESRPNGSGGFEAGFIPPVEAIER

SEQ ID NO: 939 - protein, 22 aa, Escherichia coli
VTAFLPENVLTIGGQFQHAELR

SEQ ID NO: 940 - protein, 5 aa, Escherichia coli
VEIVR

SEQ ID NO: 941 - protein, 6 aa, Escherichia coli
HFSIGR

SEQ ID NO: 942 - protein, 6 aa, Escherichia coli
RVEIVR

SEQ ID NO: 943 - protein, 7 aa, Escherichia coli
ASYFDTK

SEQ ID NO: 944 - protein, 7 aa, Escherichia coli
IFVSYQW

SEQ ID NO: 945 - protein, 7 aa, Escherichia coli
IYWSEVR

SEQ ID NO: 946 - protein, 10 aa, Escherichia coli
GVLVLVDGVR

SEQ ID NO: 947 - protein, 9 aa, Escherichia coli
IWGWDVMTK

SEQ ID NO: 948 - protein, 11 aa, Escherichia coli
DLPITLLGGTR

SEQ ID NO: 949 - protein, 10 aa, Escherichia coli
MSRPQFTSLR

SEQ ID NO: 950 - protein, 12 aa, Escherichia coli
DLLQEGQSSGFR

SEQ ID NO: 951 - protein, 13 aa, Escherichia coli
INAQNTGSSGEYR

SEQ ID NO: 952 - protein, 13 aa, Escherichia coli
EYWSPQGIPQDGR

SEQ ID NO: 953 - protein, 14 aa, Escherichia coli
FDDLMLSNDALEFK

SEQ ID NO: 954 - protein, 9 aa, Escherichia coli
AQGVQLTAK

SEQ ID NO: 955 - protein, 14 aa, Escherichia coli
YTTDLFSLDVAYNR

SEQ ID NO: 956 - protein, 16 aa, Escherichia coli
GTWQIDSAQSLSGLVR

SEQ ID NO: 957 - protein, 15 aa, Escherichia coli
IDFSSGWLQDEITLR

SEQ ID NO: 958 - protein, 21 aa, Escherichia coli
VFGTGGTGDHSLGLGASAFGR

SEQ ID NO: 959 - protein, 19 aa, Escherichia coli
QGTDTGHLNGTFLDPALIK

SEQ ID NO: 960 - protein, 20 aa, Escherichia coli
QPGYGVNDFYVSYQGQQALK

SEQ ID NO: 961 - protein, 21 aa, Escherichia coli
STLFADSFASHLLTYGGEYYR

SEQ ID NO: 962 - protein, 27 aa, Escherichia coli
FYTNYWVPNPNLRPETNETQEYGFGLR

SEQ ID NO: 963 - protein, 7 aa, Escherichia coli
SVVQTVR

SEQ ID NO: 964 - protein, 7 aa, Escherichia coli
LSQDLAR

SEQ ID NO: 965 - protein, 7 aa, Escherichia coli
LSNPELR

SEQ ID NO: 966 - protein, 8 aa, Escherichia coli
NLSLLQAR

SEQ ID NO: 967 - protein, 11 aa, Escherichia coli
SAADRDAAFEK

SEQ ID NO: 968 - protein, 12 aa, Escherichia coli
TTTSNGHNPFRN

SEQ ID NO: 969 - protein, 16 aa, Escherichia coli
TIVDVLDATTTLYNAK

SEQ ID NO: 970 - protein, 17 aa, Escherichia coli
SSFNNINASISSINAYK

SEQ ID NO: 971 - protein, 18 aa, Escherichia coli
QAQYNFVGASEQLESAHR

SEQ ID NO: 972 - protein, 18 aa, Escherichia coli
QAQYNFVGASEQLESAHR

SEQ ID NO: 973 - protein, 19 aa, Escherichia coli
QITGNYYPELAALNVENFK

SEQ ID NO: 974 - protein, 19 aa, Escherichia coli
QITGNYYPELAALNVENFK

SEQ ID NO: 975 - protein, 20 aa, Escherichia coli
SPLLPQLGLGADYTYSNGYR

SEQ ID NO: 976 - protein, 22 aa, Escherichia coli
QAVVSAQSSLDAMEAGYSVGTR

SEQ ID NO: 977 - protein, 22 aa, Escherichia coli
QAVVSAQSSLDAMEAGYSVGTR

SEQ ID NO: 978 - protein, 6 aa, Escherichia coli
LSSGLR

SEQ ID NO: 979 - protein, 6 aa, Escherichia coli
FTSNIK

SEQ ID NO: 980 - protein, 7 aa, Escherichia coli
GLTQAAR

SEQ ID NO: 981 - protein, 6 aa, Escherichia coli
LDEIDR

SEQ ID NO: 982 - protein, 9 aa, Escherichia coli
SSLGAVQNR

SEQ ID NO: 983 - protein, 8 aa, Escherichia coli
SRLDEIDR

SEQ ID NO: 984 - protein, 9 aa, Escherichia coli
AIAQVDTFR

SEQ ID NO: 985 - protein, 21 aa, Escherichia coli
LDSAVTNLNNTTTNLSEAQSR

SEQ ID NO: 986 - protein, 25 aa, Escherichia coli
NANDGISLAQTTEGALSEINNNLQR

SEQ ID NO: 987 - protein, 26 aa, Escherichia coli
GAATSQFVVQSGNDFYSASINHTDGK

SEQ ID NO: 988 - protein, 28 aa, Escherichia coli
VVVELSTAKPTAQFSGASSADPLALLDK

SEQ ID NO: 989 - protein, 7 aa, Escherichia coli
VAFAGLK

SEQ ID NO: 990 - protein, 8 aa, Escherichia coli
NLGVINGR

SEQ ID NO: 991 - protein, 8 aa, Escherichia coli
GNGFATYR

SEQ ID NO: 992 - protein, 11 aa, Escherichia coli
FQDVGSFDYGR

SEQ ID NO: 993 - protein, 12 aa, Escherichia coli
YVDVGATYYFNK

SEQ ID NO: 994 - protein, 20 aa, Escherichia coli
YDANNIYLAAQYTQTYNATR

SEQ ID NO: 995 - protein, 26 aa, Escherichia coli
AQNFEAVAQYQFDFGLRPSLAYLQSK

SEQ ID NO: 996 - protein, 7 aa, Escherichia coli
LAFAGLK

SEQ ID NO: 997 - protein, 8 aa, Escherichia coli
DLGVHGDR

SEQ ID NO: 998 - protein, 10 aa, Escherichia coli
NAEVWAAGLK

SEQ ID NO: 999 - protein, 11 aa, Escherichia coli
FGDYGSIDYGR

SEQ ID NO: 1000 - protein, 12 aa, Escherichia coli
YVDVGATYYFNK

SEQ ID NO: 1001 - protein, 17 aa, Escherichia coli
HYFSSNDADDGDTTYAR

SEQ ID NO: 1002 - protein, 20 aa, Escherichia coli
NNDFFGLVDGLNFAAQYQGK

SEQ ID NO: 1003 - protein, 20 aa, Escherichia coli
GETQINDQLTGFGQWEYEFK

SEQ ID NO: 1004 - protein, 24 aa, Escherichia coli
LGFKGETQINDQLTGFGQWEYEFK

SEQ ID NO: 1005 - protein, 7 aa, Escherichia coli
LGGMVWR

SEQ ID NO: 1006 - protein, 9 aa, Escherichia coli
DNTWYTGAK

SEQ ID NO: 1007 - protein, 7 aa, Escherichia coli
RVEIEVK

SEQ ID NO: 1008 - protein, 9 aa, Escherichia coli
DNTWYTGAK

SEQ ID NO: 1009 - protein, 12 aa, Escherichia coli
DGSVVVLGYTDR

SEQ ID NO: 1010 - protein, 12 aa, Escherichia coli
RAQSVVDYLISK

SEQ ID NO: 1011 - protein, 13 aa, Escherichia coli
IGSDAYNQALSER

SEQ ID NO: 1012 - protein, 14 aa, Escherichia coli
LGYPITDDLDVYTR

SEQ ID NO: 1013 - protein, 23 aa, Escherichia coli
FGQGEAAPVVAPAPAPAPEVQTK

SEQ ID NO: 1014 - protein, 24 aa, Escherichia coli
ATLKPEGQAALDQLYSQLSNLDPK

SEQ ID NO: 1015 - protein, 31 aa, Escherichia coli; identical to SEQ ID NO: 179

SEQ ID NO: 1016 - protein, 5 aa, Escherichia coli
YWNPK

SEQ ID NO: 1017 - protein, 7 aa, Escherichia coli
ILFVGTK

SEQ ID NO: 1018 - protein, 9 aa, Escherichia coli
LENSLGGIK

SEQ ID NO: 1019 - protein, 8 aa, Escherichia coli
VHIINLEK

SEQ ID NO: 1020 - protein, 9 aa, Escherichia coli
MKPFIFGAR

SEQ ID NO: 1021 - protein, 9 aa, Escherichia coli
SDVLFNFNK

SEQ ID NO: 1022 - protein, 10 aa, Escherichia coli
AGVHFGHQTR

SEQ ID NO: 1023 - protein, 10 aa, Escherichia coli
WLGGMLTNWK

SEQ ID NO: 1024 - protein, 11 aa, Escherichia coli
GIKDVVTQPQA

SEQ ID NO: 1025 - protein, 14 aa, Escherichia coli
AVTLYLGAVAATVR

SEQ ID NO: 1026 - protein, 13 aa, Escherichia coli
WLGGMLTNWKTVR

SEQ ID NO: 1027 - protein, 14 aa, Escherichia coli
TVPMFNEALAELNK

SEQ ID NO: 1028 - protein, 22 aa, Escherichia coli
DMGGLPDALFVIDADHEHIAIK

SEQ ID NO: 1029 - protein, 8 aa, Escherichia coli
ATVELLNR

SEQ ID NO: 1030 - protein, 7 aa, Escherichia coli
QAHWNMR

SEQ ID NO: 1031 - protein, 8 aa, Escherichia coli
ATNLLYTR

SEQ ID NO: 1032 - protein, 9 aa, Escherichia coli
YAIVANDVR

SEQ ID NO: 1033 - protein, 13 aa, Escherichia coli
TALIDHLDTMAER

SEQ ID NO: 1034 - protein, 13 aa, Escherichia coli
QVIQFIDLSLITK

SEQ ID NO: 1035 - protein, 14 aa, Escherichia coli
ELADRYAIVANDVR

SEQ ID NO: 1036 - protein, 15 aa, Escherichia coli
GANFIAVHEMLDGFR

SEQ ID NO: 1037 - protein, 14 aa, Escherichia coli
SYPLDIHNVQDHLK

SEQ ID NO: 1038 - protein, 14 aa, Escherichia coli
SYPLDIHNVQDHLK

SEQ ID NO: 1039 - protein, 21 aa, Escherichia coli
ATVELLNRQVIQFIDLSLITK

SEQ ID NO: 1040 - protein, 5 aa, Escherichia coli
ELADR

SEQ ID NO: 1041 - protein, 8 aa, Escherichia coli
ATVELLNR

SEQ ID NO: 1042 - protein, 7 aa, Escherichia coli
QAHWNMR

SEQ ID NO: 1043 - protein, 8 aa, Escherichia coli
ATNLLYTR

SEQ ID NO: 1044 - protein, 9 aa, Escherichia coli
YAIVANDVR

SEQ ID NO: 1045 - protein, 9 aa, Escherichia coli
KATVELLNR

SEQ ID NO: 1046 - protein, 10 aa, Escherichia coli
YAIVANDVRK

SEQ ID NO: 1047 - protein, 13 aa, Escherichia coli
DDDTADILTAASR

SEQ ID NO: 1048 - protein, 13 aa, Escherichia coli
TALIDHLDTMAER

SEQ ID NO: 1049 - protein, 13 aa, Escherichia coli
QVIQFIDLSLITK

SEQ ID NO: 1050 - protein, 14 aa, Escherichia coli
ELADRYAIVANDVR

SEQ ID NO: 1051 - protein, 15 aa, Escherichia coli
GANFIAVHEMLDGFR

SEQ ID NO: 1052 - protein, 14 aa, Escherichia coli
DLDKFLWFIESNIE

SEQ ID NO: 1053 - protein, 19 aa, Escherichia coli
AIGEAKDDDTADILTAASR

SEQ ID NO: 1054 - protein, 19 aa, Escherichia coli
SYPLDIHNVQDHLKELADR

SEQ ID NO: 1055 - protein, 5 aa, Escherichia coli
IEVLR

SEQ ID NO: 1056 - protein, 11 aa, Escherichia coli
DGWLAGVTWFR

SEQ ID NO: 1057 - protein, 13 aa, Escherichia coli
GDTSWVPPEMIER

SEQ ID NO: 1058 - protein, 14 aa, Escherichia coli
AETSINKEIGLEFK

SEQ ID NO: 1059 - protein, 15 aa, Escherichia coli
NVSLTGGVDNLFDKR

SEQ ID NO: 1060 - protein, 16 aa, Escherichia coli
TNFSLTGPLGDEFSFR

SEQ ID NO: 1061 - protein, 16 aa, Escherichia coli
TQADAWDINQGHQSAR

SEQ ID NO: 1062 - protein, 17 aa, Escherichia coli
WDFAPLQSLELEAGYSR

SEQ ID NO: 1063 - protein, 19 aa, Escherichia coli
QGNLYAGDTQNTNSDAYTR

SEQ ID NO: 1064 - protein, 18 aa, Escherichia coli
LSIIPEYTLNSTLSWQAR

SEQ ID NO: 1065 - protein, 18 aa, Escherichia coli
GDTSWVPPEMIERIEVLR

SEQ ID NO: 1066 - protein, 29 aa, Escherichia coli
AGNAQTTGDLAGANYIAGAGAYTYNEPGR

SEQ ID NO: 1067 - protein, 6 aa, Escherichia coli
ITLSPR

SEQ ID NO: 1068 - protein, 5 aa, Escherichia coli
NYWVR

SEQ ID NO: 1069 - protein, 7 aa, Escherichia coli
RITLSPR

SEQ ID NO: 1070 - protein, 8 aa, Escherichia coli
GIYAGQPR

SEQ ID NO: 1071 - protein, 10 aa, Escherichia coli
IPGFMLWGAR

SEQ ID NO: 1072 - protein, 11 aa, Escherichia coli
AALIDCLAPDR

SEQ ID NO: 1073 - protein, 9 aa, Escherichia coli
WQSTRPYDR

SEQ ID NO: 1074 - protein, 11 aa, Escherichia coli
ENDVFEHAGAR

SEQ ID NO: 1075 - protein, 10 aa, Escherichia coli
YLNESTHEMR

SEQ ID NO: 1076 - protein, 13 aa, Escherichia coli
IDIGNWTITPGMR

SEQ ID NO: 1077 - protein, 12 aa, Escherichia coli
FNIQGFYTQTLR

SEQ ID NO: 1078 - protein, 15 aa, Escherichia coli
YGPQSVGGVVNFVTR

SEQ ID NO: 1079 - protein, 15 aa, Escherichia coli
EDALTVVGDWLGDAR

SEQ ID NO: 1080 - protein, 15 aa, Escherichia coli
LASLGYQFQPDSQHK

SEQ ID NO: 1081 - protein, 16 aa, Escherichia coli
ADYDADRWQSTRPYDR

SEQ ID NO: 1082 - protein, 19 aa, Escherichia coli
YYTATSSGQLPSGSSPYDR

SEQ ID NO: 1083 - protein, 19 aa, Escherichia coli
YSQIFMIGPSAHEVGVGYR

SEQ ID NO: 1084 - protein, 11 aa, Escherichia coli
AQSVVDYLISK

SEQ ID NO: 1085 - protein, 6 aa, Escherichia coli
GFSAIR

SEQ ID NO: 1086 - protein, 6 aa, Escherichia coli
GFSAIR

SEQ ID NO: 1087 - protein, 6 aa, Escherichia coli
IPGTER

SEQ ID NO: 1088 - protein, 7 aa, Escherichia coli
FTGNNLR

SEQ ID NO: 1089 - protein, 9 aa, Escherichia coli
VDSYELGWR

SEQ ID NO: 1090 - protein, 12 aa, Escherichia coli
GRPLVVLVDGVR

SEQ ID NO: 1091 - protein, 11 aa, Escherichia coli
FYPFPTVNANK

SEQ ID NO: 1092 - protein, 11 aa, Escherichia coli
IDDFIGYAQQR

SEQ ID NO: 1093 - protein, 13 aa, Escherichia coli
SQGDDDYGLNLGK

SEQ ID NO: 1094 - protein, 15 aa, Escherichia coli
IAGAVSGGNEHISGR

SEQ ID NO: 1095 - protein, 15 aa, Escherichia coli
GTSTPFVSNGLNSDR

SEQ ID NO: 1096 - protein, 15 aa, Escherichia coli
ATAYIGWAPDPWSLR

SEQ ID NO: 1097 - protein, 16 aa, Escherichia coli
VQSTTSFDVSDAQGYK

SEQ ID NO: 1098 - protein, 18 aa, Escherichia coli
APLYYSPGYGPASLYDYK

SEQ ID NO: 1099 - protein, 18 aa, Escherichia coli
QVTAFSSSQQDTDQYGMK

SEQ ID NO: 1100 - protein, 21 aa, Escherichia coli
GQPETMMEFEAGTKSGFSSSK

SEQ ID NO: 1101 - protein, 24 aa, Escherichia coli
HLISLQYSDSAFLGQELVGQVYYR

SEQ ID NO: 1102 - protein, 26 aa, Escherichia coli
FGGWFDGNGDATLLDNTQTGLQYSDR

SEQ ID NO: 1103 - protein, 5 aa, Escherichia coli
FEQPR

SEQ ID NO: 1104 - protein, 5 aa, Escherichia coli
VEYIR

SEQ ID NO: 1105 - protein, 14 aa, Escherichia coli
YDKDYSSYPYQTVK

SEQ ID NO: 1106 - protein, 16 aa, Escherichia coli
QWEGAFEGLTAGVNWR

SEQ ID NO: 1107 - protein, 19 aa, Escherichia coli
SAVYGSDAIGGVVNIITTR

SEQ ID NO: 1108 - protein, 16 aa, Escherichia coli
QDIDRWQSTSVNDVLR

SEQ ID NO: 1109 - protein, 17 aa, Escherichia coli
HGTWQTSAGWEFIEGYR

SEQ ID NO: 1110 - protein, 21 aa, Escherichia coli
LPGVDITQNGGSGQLSSIFIR

SEQ ID NO: 1111 - protein, 20 aa, Escherichia coli
APNLGQLYGFYGNPNLDPEK

SEQ ID NO: 1112 - protein, 22 aa, Escherichia coli
LNLAGVSGSADLSQFPIALVQR

SEQ ID NO: 1113 - protein, 20 aa, Escherichia coli
IANLFDKDYETVYGYQTAGR

SEQ ID NO: 1114 - protein, 22 aa, Escherichia coli
NTGIYLTGLQQVGDFTFEGAAR

SEQ ID NO: 1115 - protein, 25 aa, Escherichia coli
GVEATANFDTGPLTHTVSYDYVDAR

SEQ ID NO: 1116 - protein, 7 aa, Escherichia coli
SVVQTVR

SEQ ID NO: 1117 - protein, 7 aa, Escherichia coli
LSQDLAR

SEQ ID NO: 1118 - protein, 7 aa, Escherichia coli
LSNPELR

SEQ ID NO: 1119 - protein, 8 aa, Escherichia coli
NLSLLQAR

SEQ ID NO: 1120 - protein, 11 aa, Escherichia coli
TTTSNGHNPFR

SEQ ID NO: 1121 - protein, 11 aa, Escherichia coli
NNLDNAVEQLR

SEQ ID NO: 1122 - protein, 12 aa, Escherichia coli
TDKPQPVNALLK

SEQ ID NO: 1123 - protein, 12 aa, Escherichia coli
TTTSNGHNPFRN

SEQ ID NO: 1124 - protein, 14 aa, Escherichia coli
AQYDTVLANEVTAR

SEQ ID NO: 1125 - protein, 15 aa, Escherichia coli
FNVGLVAITDVQNAR

SEQ ID NO: 1126 - protein, 16 aa, Escherichia coli
TIVDVLDATTTLYNAK

SEQ ID NO: 1127 - protein, 17 aa, Escherichia coli
SSFNNINASISSINAYK

SEQ ID NO: 1128 - protein, 18 aa, Escherichia coli
QAQYNFVGASEQLESAHR

SEQ ID NO: 1129 - protein, 20 aa, Escherichia coli
VGLSFSLPIYQGGMVNSQVK

SEQ ID NO: 1130 - protein, 19 aa, Escherichia coli
QITGNYYPELAALNVENFK

SEQ ID NO: 1131 - protein, 22 aa, Escherichia coli
QAVVSAQSSLDAMEAGYSVGTR

SEQ ID NO: 1132 - protein, 7 aa, Escherichia coli
LSLAATR

SEQ ID NO: 1133 - protein, 7 aa, Escherichia coli
LGQEVWK

SEQ ID NO: 1134 - protein, 8 aa, Escherichia coli
VDFHGYAR

SEQ ID NO: 1135 - protein, 13 aa, Escherichia coli
FAYNINNNGHMLR

SEQ ID NO: 1136 - protein, 11 aa, Escherichia coli
LGGMVWRADTK

SEQ ID NO: 1137 - protein, 15 aa, Escherichia coli
FVVQYATDSMTSQGK

SEQ ID NO: 1138 - protein, 15 aa, Escherichia coli
NLIEWLPGSTIWAGK

SEQ ID NO: 1139 - protein, 15 aa, Escherichia coli
DGWLFTAEHTQSVLK

SEQ ID NO: 1140 - protein, 20 aa, Escherichia coli
LAQMEINPGGTLELGVDYGR

SEQ ID NO: 1141 - protein, 12 aa, Escherichia coli
DGSVVVLGYTDR

SEQ ID NO: 1142 - protein, 19 aa, Escherichia coli
LGNECETYAELKLGQEVWK

SEQ ID NO: 1143 - protein, 20 aa, Escherichia coli
WTPIMSTVMEIGYDNVESQR

SEQ ID NO: 1144 - protein, 12 aa, Escherichia coli
AALIDCLAPDRR

SEQ ID NO: 1145 - protein, 30 aa, Escherichia coli
SSEAGGSSSFASNNIYDYTNETANDVFDVR

SEQ ID NO: 1146 - protein, 6 aa, Escherichia coli
YALTYR

SEQ ID NO: 1147 - protein, 9 aa, Escherichia coli
GNYSSDLNR

SEQ ID NO: 1148 - protein, 9 aa, Escherichia coli
SISIPDQDR

SEQ ID NO: 1149 - protein, 12 aa, Escherichia coli
ATSTSGDTLFQK

SEQ ID NO: 1150 - protein, 13 aa, Escherichia coli
INEGPYQFESEGK

SEQ ID NO: 1151 - protein, 13 aa, Escherichia coli
FWLSAGTTYAFNK

SEQ ID NO: 1152 - protein, 15 aa, Escherichia coli
TGIAFDDSPVPAQNR

SEQ ID NO: 1153 - protein, 17 aa, Escherichia coli
AYSGEGAIADDAGNVSR

SEQ ID NO: 1154 - protein, 17 aa, Escherichia coli
DASVDVGVSYMHGQSVK

SEQ ID NO: 1155 - protein, 17 aa, Escherichia coli
LNNAWSFGLGFNAVYAR

SEQ ID NO: 1156 - protein, 16 aa, Escherichia coli
IALGTTYYYDDNWTFR

SEQ ID NO: 1157 - protein, 8 aa, Escherichia coli
TTGVATYR

SEQ ID NO: 1158 - protein, 11 aa, Escherichia coli
FGDYGSIDYGR

SEQ ID NO: 1159 - protein, 12 aa, Escherichia coli
YVDVGATYYFNK

SEQ ID NO: 1160 - protein, 17 aa, Escherichia coli
HYFSSNDADDGDTTYAR

SEQ ID NO: 1161 - protein, 20 aa, Escherichia coli
NNDFFGLVDGLNFAAQYQGK

SEQ ID NO: 1162 - protein, 20 aa, Escherichia coli
GETQINDQLTGFGQWEYEFK

SEQ ID NO: 1163 - protein, 23 aa, Escherichia coli
NNDFFGLVDGLNFAAQYQGKNDR

SEQ ID NO: 1164 - protein, 26 aa, Escherichia coli
AQNFEAVAQYQFDFGLRPSVAYLQSK

SEQ ID NO: 1165 - protein, 29 aa, Escherichia coli
YDANNIYLATTYSETQNMTVFGNNHIANK

SEQ ID NO: 1166 - protein, 7 aa, Escherichia coli
LGGMVWR

SEQ ID NO: 1167 - protein, 12 aa, Escherichia coli
DGSVVVLGYTDR

SEQ ID NO: 1168 - protein, 14 aa, Escherichia coli
ADTKANVPGGASYK

SEQ ID NO: 1169 - protein, 23 aa, Escherichia coli
FGQGEAAPVVAPAPAPAPEVQTK

SEQ ID NO: 1170 - protein, 24 aa, Escherichia coli
ATLKPEGQAALDQLYSQLSNLDPK

SEQ ID NO: 1171 - protein, 25 aa, Escherichia coli
DHDTGVSPVFAGGVEYAITPEIATR

SEQ ID NO: 1172 - protein, 5 aa, Escherichia coli
YWNPK

SEQ ID NO: 1173 - protein, 7 aa, Escherichia coli
ILFVGTK

SEQ ID NO: 1174 - protein, 9 aa, Escherichia coli
LENSLGGIK

SEQ ID NO: 1175 - protein, 8 aa, Escherichia coli
VHIINLEK

SEQ ID NO: 1176 - protein, 9 aa, Escherichia coli
MKPFIFGAR

SEQ ID NO: 1177 - protein, 12 aa, Escherichia coli
RAQSVVDYLISK

SEQ ID NO: 1178 - protein, 10 aa, Escherichia coli
AGVHFGHQTR

SEQ ID NO: 1179 - protein, 10 aa, Escherichia coli
WLGGMLTNWK

SEQ ID NO: 1180 - protein, 13 aa, Escherichia coli
IGSDAYNQGLSER

SEQ ID NO: 1181 - protein, 14 aa, Escherichia coli
AVTLYLGAVAATVR

SEQ ID NO: 1182 - protein, 14 aa, Escherichia coli
TVPMFNEALAELNK

SEQ ID NO: 1183 - protein, 14 aa, Escherichia coli
LGYPITDDLDIYTR

SEQ ID NO: 1184 - protein, 22 aa, Escherichia coli
DMGGLPDALFVIDADHEHIAIK

SEQ ID NO: 1185 - protein, 6 aa, Escherichia coli
FGPQIR

SEQ ID NO: 1186 - protein, 12 aa, Escherichia coli
LTNTDLSFGPFK

SEQ ID NO: 1187 - protein, 12 aa, Escherichia coli
NDTYLEYEAFAK

SEQ ID NO: 1188 - protein, 14 aa, Escherichia coli
EWYFANNYIYDMGR

SEQ ID NO: 1189 - protein, 19 aa, Escherichia coli
GMGESNPVTGNTCDNVKQR

SEQ ID NO: 1190 - protein, 16 aa, Escherichia coli
GIWNHGSPLFMEIEPR

SEQ ID NO: 1191 - protein, 23 aa, Escherichia coli
FGQGEAAPVVAPAPAPAPEVQTK

SEQ ID NO: 1192 - protein, 18 aa, Escherichia coli
YQWQNYGAANENEWDGYR

SEQ ID NO: 1193 - protein, 24 aa, Escherichia coli
YWHDGGQWNDDAELNFGNGNFNVR

SEQ ID NO: 1194 - protein, 25 aa, Escherichia coli
TNNSIASSHILALNYDHWHYSVVAR

SEQ ID NO: 1195 - protein, 8 aa, Escherichia coli
ATVELLNR

SEQ ID NO: 1196 - protein, 7 aa, Escherichia coli
QAHWNMR

SEQ ID NO: 1197 - protein, 8 aa, Escherichia coli
ATNLLYTR

SEQ ID NO: 1198 - protein, 9 aa, Escherichia coli
YAIVANDVR

SEQ ID NO: 1199 - protein, 13 aa, Escherichia coli
DDDTADILTAASR

SEQ ID NO: 1200 - protein, 13 aa, Escherichia coli
TALIDHLDTMAER

SEQ ID NO: 1201 - protein, 13 aa, Escherichia coli
QVIQFIDLSLITK

SEQ ID NO: 1202 - protein, 14 aa, Escherichia coli
ELADRYAIVANDVR

SEQ ID NO: 1203 - protein, 15 aa, Escherichia coli
GANFIAVHEMLDGFR

SEQ ID NO: 1204 - protein, 14 aa, Escherichia coli
SYPLDIHNVQDHLK

SEQ ID NO: 1205 - protein, 18 aa, Escherichia coli
AVQLGGVALGTTQVINSK

SEQ ID NO: 1206 - protein, 19 aa, Escherichia coli
AIGEAKDDDTADILTAASR

SEQ ID NO: 1207 - protein, 19 aa, Escherichia coli
SYPLDIHNVQDHLKELADR

SEQ ID NO: 1208 - protein, 5 aa, Escherichia coli
ELADR

SEQ ID NO: 1209 - protein, 8 aa, Escherichia coli
ATVELLNR

SEQ ID NO: 1210 - protein, 7 aa, Escherichia coli
QAHWNMR

SEQ ID NO: 1211 - protein, 8 aa, Escherichia coli
ATNLLYTR

SEQ ID NO: 1212 - protein, 9 aa, Escherichia coli
YAIVANDVR

SEQ ID NO: 1213 - protein, 9 aa, Escherichia coli
KATVELLNR

SEQ ID NO: 1214 - protein, 10 aa, Escherichia coli
YAIVANDVRK

SEQ ID NO: 1215 - protein, 13 aa, Escherichia coli
DDDTADILTAASR

SEQ ID NO: 1216 - protein, 13 aa, Escherichia coli
TALIDHLDTMAER

SEQ ID NO: 1217 - protein, 13 aa, Escherichia coli
QVIQFIDLSLITK

SEQ ID NO: 1218 - protein, 14 aa, Escherichia coli
ELADRYAIVANDVR

SEQ ID NO: 1219 - protein, 15 aa, Escherichia coli
GANFIAVHEMLDGFR

SEQ ID NO: 1220 - protein, 18 aa, Escherichia coli
AVQLGGVALGTTQVINSK

SEQ ID NO: 1221 - protein, 14 aa, Escherichia coli
DLDKFLWFIESNIE

SEQ ID NO: 1222 - protein, 19 aa, Escherichia coli
AIGEAKDDDTADILTAASR

SEQ ID NO: 1223 - protein, 19 aa, Escherichia coli
SYPLDIHNVQDHLKELADR

SEQ ID NO: 1224 - protein, 7 aa, Escherichia coli
YGYAYPR

SEQ ID NO: 1225 - protein, 9 aa, Escherichia coli
LAGDLETLR

SEQ ID NO: 1226 - protein, 9 aa, Escherichia coli
GYFPTDGSR

SEQ ID NO: 1227 - protein, 10 aa, Escherichia coli
WGYGDGLGGK

SEQ ID NO: 1228 - protein, 9 aa, Escherichia coli
DIHFEGLQR

SEQ ID NO: 1229 - protein, 11 aa, Escherichia coli
GLEDFYYSVGK

SEQ ID NO: 1230 - protein, 12 aa, Escherichia coli
ALFATGNFEDVR

SEQ ID NO: 1231 - protein, 13 aa, Escherichia coli
VPGSPDQVDVVYK

SEQ ID NO: 1232 - protein, 12 aa, Escherichia coli
DEVPWWNVVGDR

SEQ ID NO: 1233 - protein, 14 aa, Escherichia coli
ERPTIASITFSGNK

SEQ ID NO: 1234 - protein, 13 aa, Escherichia coli
LGFFETVDTDTQR

SEQ ID NO: 1235 - protein, 15 aa, Escherichia coli
GIYVTVNITEGDQYK

SEQ ID NO: 1236 - protein, 15 aa, Escherichia coli
YDGDKAEQFQFNIGK

SEQ ID NO: 1237 - protein, 14 aa, Escherichia coli
TDDFTFNYGWTYNK

SEQ ID NO: 1238 - protein, 17 aa, Escherichia coli
EMPFYENFYAGGSSTVR

SEQ ID NO: 1239 - protein, 19 aa, Escherichia coli
SYGTDVTLGFPINEYNSLR

SEQ ID NO: 1240 - protein, 17 aa, Escherichia coli
TDDFTFNYGWTYNKLDR

SEQ ID NO: 1241 - protein, 22 aa, Escherichia coli
LSGVEVSGNLAGHSAEIEQLTK

SEQ ID NO: 1242 - protein, 19 aa, Escherichia coli
LFYNDFQADDADLSDYTNK

SEQ ID NO: 1243 - protein, 26 aa, Escherichia coli
LGFFETVDTDTQRVPGSPDQVDVVYK

SEQ ID NO: 1244 - protein, 7 aa, Escherichia coli
LVQLNYR

SEQ ID NO: 1245 - protein, 9 aa, Escherichia coli
AQYLYVPYR

SEQ ID NO: 1246 - protein, 12 aa, Escherichia coli
YGSSTDGYATQK

SEQ ID NO: 1247 - protein, 10 aa, Escherichia coli
GNIMWENEFR

SEQ ID NO: 1248 - protein, 11 aa, Escherichia coli
LQADEVQLHQK

SEQ ID NO: 1249 - protein, 11 aa, Escherichia coli
EEQVAEIWNAR

SEQ ID NO: 1250 - protein, 12 aa, Escherichia coli
IYGQAVHFVNTR

SEQ ID NO: 1251 - protein, 11 aa, Escherichia coli
RGNIMWENEFR

SEQ ID NO: 1252 - protein, 13 aa, Escherichia coli
VSDPSYFNDFDNK

SEQ ID NO: 1253 - protein, 14 aa, Escherichia coli
DTNVWEGDYQMVGR

SEQ ID NO: 1254 - protein, 14 aa, Escherichia coli
VYEDEHPNDDSSRR

SEQ ID NO: 1255 - protein, 15 aa, Escherichia coli
WSIVGAYYYDTNANK

SEQ ID NO: 1256 - protein, 15 aa, Escherichia coli
FNISVGQIYYFTESR

SEQ ID NO: 1257 - protein, 17 aa, Escherichia coli
FSVGYAVQNFNATVSTK

SEQ ID NO: 1258 - protein, 16 aa, Escherichia coli
QHAVYDNAIGFNIELR

SEQ ID NO: 1259 - protein, 18 aa, Escherichia coli
TVDALGNVHYDDNQVILK

SEQ ID NO: 1260 - protein, 19 aa, Escherichia coli
VGPVPIFYSPYLQLPVGDK

SEQ ID NO: 1261 - protein, 12 aa, Escherichia coli
AGTYATTLPAGR

SEQ ID NO: 1262 - protein, 12 aa, Escherichia coli
AGTYATTLPAGR

SEQ ID NO: 1263 - protein, 11 aa, Escherichia coli
DGWLAGVTWFR

SEQ ID NO: 1264 - protein, 13 aa, Escherichia coli
GDTSWVPPEMIER

SEQ ID NO: 1265 - protein, 14 aa, Escherichia coli
AETSINKEIGLEFK

SEQ ID NO: 1266 - protein, 15 aa, Escherichia coli
NVSLTGGVDNLFDKR

SEQ ID NO: 1267 - protein, 16 aa, Escherichia coli
TNFSLTGPLGDEFSFR

SEQ ID NO: 1268 - protein, 16 aa, Escherichia coli
TQADAWDINQGHQSAR

SEQ ID NO: 1269 - protein, 16 aa, Escherichia coli
APSLYQTNPNYILYSK

SEQ ID NO: 1270 - protein, 17 aa, Escherichia coli
WDFAPLQSLELEAGYSR

SEQ ID NO: 1271 - protein, 18 aa, Escherichia coli
GDTSWVPPEMIERIEVLR

SEQ ID NO: 1272 - protein, 19 aa, Escherichia coli
GSGEWHGSWDAYFNAPEHK

SEQ ID NO: 1273 - protein, 20 aa, Escherichia coli
KGSGEWHGSWDAYFNAPEHK

SEQ ID NO: 1274 - protein, 25 aa, Escherichia coli
IEAGYVAVGQNAVGTDLYQWDNVPK

SEQ ID NO: 1275 - protein, 29 aa, Escherichia coli
AGNAQTTGDLAGANYIAGAGAYTYNEPGR

SEQ ID NO: 1276 - protein, 28 aa, Escherichia coli
FDHHSIVGNNWSPALNISQGLGDDFTLK

SEQ ID NO: 1277 - protein, 27 aa, Escherichia coli
QNYALTWNGGWDNGVTTSNWVQYEHTR

SEQ ID NO: 1278 - protein, 4 aa, Escherichia coli
FWGR

SEQ ID NO: 1279 - protein, 6 aa, Escherichia coli
ITLSPR

SEQ ID NO: 1280 - protein, 5 aa, Escherichia coli
NYWVR

SEQ ID NO: 1281 - protein, 8 aa, Escherichia coli
GIYAGQPR

SEQ ID NO: 1282 - protein, 7 aa, Escherichia coli
TWELGTR

SEQ ID NO: 1283 - protein, 10 aa, Escherichia coli
IPGFMLWGAR

SEQ ID NO: 1284 - protein, 9 aa, Escherichia coli
WQSTRPYDR

SEQ ID NO: 1285 - protein, 11 aa, Escherichia coli
ENDVFEHAGAR

SEQ ID NO: 1286 - protein, 10 aa, Escherichia coli
YLNESTHEMR

SEQ ID NO: 1287 - protein, 10 aa, Escherichia coli
YLNESTHEMR

SEQ ID NO: 1288 - protein, 10 aa, Escherichia coli
NIFDQDYFIR

SEQ ID NO: 1289 - protein, 12 aa, Escherichia coli
FNIQGFYTQTLR

SEQ ID NO: 1290 - protein, 15 aa, Escherichia coli
YGPQSVGGVVNFVTR

SEQ ID NO: 1291 - protein, 15 aa, Escherichia coli
EDALTVVGDWLGDAR

SEQ ID NO: 1292 - protein, 15 aa, Escherichia coli
EKGDTYGNLVPFSPK

SEQ ID NO: 1293 - protein, 15 aa, Escherichia coli
SYDDNNKGIYAGQPR

SEQ ID NO: 1294 - protein, 15 aa, Escherichia coli
LASLGYQFQPDSQHK

SEQ ID NO: 1295 - protein, 16 aa, Escherichia coli
ADYDADRWQSTRPYDR

SEQ ID NO: 1296 - protein, 19 aa, Escherichia coli
YYTATSSGQLPSGSSPYDR

SEQ ID NO: 1297 - protein, 19 aa, Escherichia coli
YSQIFMIGPSAHEVGVGYR

SEQ ID NO: 1298 - protein, 21 aa, Escherichia coli
ALNQYAAHSGFTLSVDASLTR

SEQ ID NO: 1299 - protein, 25 aa, Escherichia coli
ETHNLMVGGTADNGFGTALLYSGTR

SEQ ID NO: 1300 - protein, 26 aa, Escherichia coli
AIPQDFGIEAGVEGQLSPTSSQNNPK

SEQ ID NO: 1301 - protein, 26 aa, Escherichia coli
SGTEAHAWYLDDKIDIGNWTITPGMR

SEQ ID NO: 1302 - protein, 27 aa, Escherichia coli
YDLGTLTPTLDNVSIYASYAYVNAEIR

SEQ ID NO: 1303 - protein, 28 aa, Escherichia coli
YAPDEVHTFNSLLQYYDGEADMPGGLSR

SEQ ID NO: 1304 - protein, 4 aa, Escherichia coli
YDVK

SEQ ID NO: 1305 - protein, 6 aa, Escherichia coli
GFSAIR

SEQ ID NO: 1306 - protein, 7 aa, Escherichia coli
FTGNNLR

SEQ ID NO: 1307 - protein, 9 aa, Escherichia coli
VDSYELGWR

SEQ ID NO: 1308 - protein, 10 aa, Escherichia coli
TFGLNYSVLF

SEQ ID NO: 1309 - protein, 12 aa, Escherichia coli
GRPLVVLVDGVR

SEQ ID NO: 1310 - protein, 11 aa, Escherichia coli
FYPFPTVNANK

SEQ ID NO: 1311 - protein, 11 aa, Escherichia coli
IDDFIGYAQQR

SEQ ID NO: 1312 - protein, 12 aa, Escherichia coli
GRTFGLNYSVLF

SEQ ID NO: 1313 - protein, 13 aa, Escherichia coli
SQGDDDYGLNLGK

SEQ ID NO: 1314 - protein, 15 aa, Escherichia coli
IAGAVSGGNEHISGR

SEQ ID NO: 1315 - protein, 15 aa, Escherichia coli
GIYGAAVNGHLPLTK

SEQ ID NO: 1316 - protein, 15 aa, Escherichia coli
GTSTPFVSNGLNSDR

SEQ ID NO: 1317 - protein, 15 aa, Escherichia coli
DALAQLIPGLDVSSR

SEQ ID NO: 1318 - protein, 14 aa, Escherichia coli
LEGVKVDSYELGWR

SEQ ID NO: 1319 - protein, 15 aa, Escherichia coli
ATAYIGWAPDPWSLR

SEQ ID NO: 1320 - protein, 18 aa, Escherichia coli
ELKDALAQLIPGLDVSSR

SEQ ID NO: 1321 - protein, 18 aa, Escherichia coli
QQAWLNFSQGVELPDPGK

SEQ ID NO: 1322 - protein, 18 aa, Escherichia coli
APLYYSPGYGPASLYDYK

SEQ ID NO: 1323 - protein, 21 aa, Escherichia coli
GTSTPFVSNGLNSDRIPGTER

SEQ ID NO: 1324 - protein, 18 aa, Escherichia coli
YQYTENKIDDFIGYAQQR

SEQ ID NO: 1325 - protein, 22 aa, Escherichia coli
QQAWLNFSQGVELPDPGKYYGR

SEQ ID NO: 1326 - protein, 24 aa, Escherichia coli
HLISLQYSDSAFLGQELVGQVYYR

SEQ ID NO: 1327 - protein, 26 aa, Escherichia coli
FGGWFDGNGDATLLDNTQTGLQYSDR

SEQ ID NO: 1328 - protein, 30 aa, Escherichia coli
ATSADAIPGGSVDYDNFLFNAGLLMHITER

SEQ ID NO: 1329 - protein, 30 aa, Escherichia coli
YPSYDITNLAAFLQSGYDINNLFTLNGGVR

SEQ ID NO: 1330 - protein, 29 aa, Escherichia coli
HLISLQYSDSAFLGQELVGQVYYRDESLR

SEQ ID NO: 1331 - protein, 5 aa, Escherichia coli
VEYIR

SEQ ID NO: 1332 - protein, 10 aa, Escherichia coli
NAITDTPLLR

SEQ ID NO: 1333 - protein, 10 aa, Escherichia coli
FIASYGTSYK

SEQ ID NO: 1334 - protein, 12 aa, Escherichia coli
STVLAPTTVVTR

SEQ ID NO: 1335 - protein, 11 aa, Escherichia coli
SQLITSYSHSK

SEQ ID NO: 1336 - protein, 11 aa, Escherichia coli
LYSQSWDAGLR

SEQ ID NO: 1337 - protein, 10 aa, Escherichia coli
DYNYDPHYGR

SEQ ID NO: 1338 - protein, 11 aa, Escherichia coli
WQSTSVNDVLR

SEQ ID NO: 1339 - protein, 11 aa, Escherichia coli
DYSSYPYQTVK

SEQ ID NO: 1340 - protein, 12 aa, Escherichia coli
KLYSQSWDAGLR

SEQ ID NO: 1341 - protein, 13 aa, Escherichia coli
DYETVYGYQTAGR

SEQ ID NO: 1342 - protein, 15 aa, Escherichia coli
GTNASHVLVLIDGVR

SEQ ID NO: 1343 - protein, 14 aa, Escherichia coli
YDKDYSSYPYQTVK

SEQ ID NO: 1344 - protein, 15 aa, Escherichia coli
NDVSDLIDYDDHTLK

SEQ ID NO: 1345 - protein, 17 aa, Escherichia coli
QTTTPGTGYVEDGYDQR

SEQ ID NO: 1346 - protein, 19 aa, Escherichia coli
SAVYGSDAIGGVVNIITTR

SEQ ID NO: 1347 - protein, 17 aa, Escherichia coli
TNYDAYYSPGSPLLDTR

SEQ ID NO: 1348 - protein, 17 aa, Escherichia coli
HGTWQTSAGWEFIEGYR

SEQ ID NO: 1349 - protein, 21 aa, Escherichia coli
LPGVDITQNGGSGQLSSIFIR

SEQ ID NO: 1350 - protein, 20 aa, Escherichia coli
APNLGQLYGFYGNPNLDPEK

SEQ ID NO: 1351 - protein, 22 aa, Escherichia coli
LNLAGVSGSADLSQFPIALVQR

SEQ ID NO: 1352 - protein, 15 aa, Salmonella enterica
GIYITVNITEGDQYK

SEQ ID NO: 1353 - protein, 16 aa, Salmonella enterica
QMEGAWLGSDLVDQGK

SEQ ID NO: 1354 - protein, 15 aa, Salmonella enterica
YDGDKAEQFQFNIGK

SEQ ID NO: 1355 - protein, 16 aa, Salmonella enterica
VSLDTATYVPIDNDHK

SEQ ID NO: 1356 - protein, 19 aa, Salmonella enterica
LSGVQVSGNLAGHSAEIEK

SEQ ID NO: 1357 - protein, 17 aa, Salmonella enterica
EMPFYENFYAGGSSTVR

SEQ ID NO: 1358 - protein, 19 aa, Salmonella enterica
SYGTDVTLGFPINEYNTLR

SEQ ID NO: 1359 - protein, 19 aa, Salmonella enterica
IFYNDFEADDADLSDYTNK

SEQ ID NO: 1360 - protein, 22 aa, Salmonella enterica
LLIASLLFSSATVYGAEGFVVK

SEQ ID NO: 1361 - protein, 24 aa, Salmonella enterica
IQQINIVGNHAFSTEELISHFQLR

SEQ ID NO: 1362 - protein, 26 aa, Salmonella enterica
NDYQTYSELSVTNPYFTVDGVSLGGR

SEQ ID NO: 1363 - protein, 7 aa, Salmonella enterica
LVQLNYR

SEQ ID NO: 1364 - protein, 8 aa, Salmonella enterica
SGVQYDTR

SEQ ID NO: 1365 - protein, 9 aa, Salmonella enterica
SGFLIPNAK

SEQ ID NO: 1366 - protein, 9 aa, Salmonella enterica
WGSLNTEAK

SEQ ID NO: 1367 - protein, 751 aa, Salmonella enterica
MNKKIHSLTLLVNLGIYGAALPVMAEEKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGIRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 1368 - protein, 726 aa, Salmonella enterica
MGMKVNKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWRMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 1369 - protein, 663 aa, Salmonella enterica
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVSLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGNYTGRKRADSATAKTPGGYVVWDTGAAWQATKNVKLRAGVLNVGDKDLKRDDYGYTEDGRRYFMAVDYRF

SEQ ID NO: 1370 - protein, 614 aa, Salmonella enterica
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLHFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGMTYQYLGSRYDSDYSAYPYRTVKMGGVSLWDLTVAYPVTSHLTVRGKIANLFDKDYETVYGYQTAGREYTLSGSYTF

SEQ ID NO: 1371 - protein, 506 aa, Salmonella enterica
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 1372 - protein, 487 aa, Salmonella enterica
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQKKYDVDSTGVTQSLDLKTAGITGATLKAGITGTTTETGSVKDGKVYYDADSKNYYVEVDFTDTTDKAAHAGFYKADVDADGNVSLATGATKEAKPTNAVEVEKTIDEKPLKASSSVQDALKASGIADAVAEAATVVKMSYTDKNGKTIDGGYGIKVGDDYYAATKEKDGSYSINSTSYTDKDGNTKTALNQLGGADGKTEVVSIDGKTYNASKAAGHNFKAQPDLAEAAATTTENPLQKIDAALAQVDALRSDLGAVQNRFNSAITNLGNTVNNLSSARSRIEDSDYATEVSNMSRAQILQQAGTSVLARV

SEQ ID NO: 1373 - protein, 491 aa, Salmonella enterica
MQMKKLLPILIGLSLSGFSTLSQAENLMQVYQQARLSNPELRKSAADRDAAFEKINEARSPLLPQLGLGADYTYSNGYRDANGINSNETSASLQLTQTLFDMSKWRGLTLQEKAAGIQDVTYQTDQQTLILNTANAYFKVLNAIDVLSYTQAQKEAIYRQLDQTTQRFNVGLVAITDVQNARAQYDTVLANEVTARNNLDNAVEELRQVTGNYYPELASLNVEHFKTDKPKAVNALLKEAENRNLSLLQARLSQDLAREQIRQAQDGHLPTLNLTASTGISDTSYSGSKTNSAQYDDSNMGQNKIGLNFSLPLYQGGMVNSQVKQAQYNFVGASEQLESAHRSVVQTVRSSFNNINASISSINAYKQAVVSAQSSLDAMEAGYSVGTRTIVDVLDATTTLYDAKQQLANARYTYLINQLNIKYALGTLNEQDLLALNSTLGKPIPTSPESVAPETPEQDAAADGYNAHSAAPAVQPTAARANSNNGNPFRH

SEQ ID NO: 1374 - protein, 427 aa, Salmonella enterica
VDFHGYARSGIGWTGSGGEQQCFQATGAQSKYRLGNECETYAELKLGQEVWKEGDKSFYFDTNVAYSVNQQNDWESTDPAFREANVQGKNLIEWLPGSTIWAGKRFYQRHDVHMIDFYYWDISGPGAGIENIDLGFGKLSLAATRSTEAGGSYTFSSQNIYDEVKDTANDVFDVRLAGLQTNPDGVLELGVDYGRANTTDGYKLADGASKDGWMFTAEHTQSMLKGYNKFVVQYATDAMTTQGKGQARGSDGSSSFTEELSDGTKINYANKVINNNGNMWRILDHGAISLGDKWDLMYVGMYQNIDWDNNLGTEWWTVGVRPMYKWTPIMSTLLEVGYDNVKSQQTGDRNNQYKITLAQQWQAGDSIWSRPAIRIFATYAKWDEKWGYIKDGDNISRYAAATNSGISTNSRGDSDEWTFGAQMEIWW

SEQ ID NO: 1375 - protein, 362 aa, Salmonella enterica
MKLKLVAVAVTSLLAAGVVNAAEVYNKDGNKLDLYGKVHAQHYFSDDNGSDGDKTYARLGFKGETQINDQLTGFGQWEYEFKGNRTESQGADKDKTRLAFAGLKFADYGSFDYGRNYGVAYDIGAWTDVLPEFGGDTWTQTDVFMTGRTTGVATYRNTDFFGLVEGLNFAAQYQGKNDRDGAYESNGDGFGLSATYEYEGFGVGAAYAKSDRTNNQVKAASNLNAAGKNAEVWAAGLKYDANNIYLATTYSETLNMTTFGEDAAGDAFIANKTQNFEAVAQYQFDFGLRPSIAYLKSKGKNLGTYGDQDLVEYIDVGATYYFNKNMSTFVDYKINLLDDSDFTKAAKVSTDNIVAVGLNYQF

SEQ ID NO: 1376 - protein, 378 aa, Salmonella enterica
MKVKVLSLLVPALLVAGAANAAEIYNKDGNKLDLFGKVDGLNYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQDNTANARLYGNGDRATVYTGGLKYDANNIYVAAQYFQTYNATRFGTSNGSNPSTSYGFANKAQNFEVVAQYQFDFGLRPSVAYLQSKGKDISNGYGASYGDQDIVKYVDVGATYYFNTNMSTYVDYKINLLDKYEFTRDAGINTDDIVALGLVYQF

SEQ ID NO: 1377 - protein, 350 aa, Salmonella enterica
MKKTAIAIAVALAGFATVAQAAPKDNTWYAGAKLGWSQYHDTGFIHNDGPTHENQLGAGAFGGYQVNPYVGFEMGYDWLGRMPYKGDNTNGAYKAQGVQLTAKLGYPITDDLDVYTRLGGMVWRADTKSNVPGGASTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 1378 - protein, 185 aa, Salmonella enterica
FMRAGPATVRPTEGAGGTLGHLNGFDVSNNTQLGLTFTYMATDNIGVELLAATPFRHKVGTGATGDIATVHLLPPTLMAQWYFGDSSSKVRPYVGVGVNYTTFFDNDFNDNGKNAGLSDLSFKDSWGAAGQVGVDYLINRDWLIGASVWYMDIDTTANYKMGGVQHHDSVRLDPWVFMFSAGYRF

SEQ ID NO: 1379 - protein, 171 aa, Salmonella enterica
MKKIACLSALAAVLAFSAGTAVAATSTVTGGYAQSDAQGVANKMSGFNLKYRYEQDDNPLGVIGSFTYTEKDRTNGAGDYNKGQYYGITAGPAYRLNDWASIYGVVGVGYGKFQTTDYPTYKHDTSDYGFSYGAGLQFNPMENVALDFSYEQSRIRSVDVGTWIAGVGYRF

SEQ ID NO: 1380 - protein, 78 aa, Salmonella enterica
MNRTKLVLGAVILGSTLLAGCSSNAKIDQLSSDVQTLNAKVDQLSNDVNAMRSDVQAAKDDAARANQRLDNQATKYRK

SEQ ID NO: 1381 - protein, 803 aa, Salmonella enterica
MAMKKLLIASLLFSSATVYGAEGFVVKDIHFEGLQRVAVGAALLSMPVRTGDTVNDEDISNTIRALFATGNFEDVRVLRDGNTLLVQVKERPTIASITFSGNKSVKDDMLKQNLEASGVRVGESLDRTTLSDIEKGLEDFYYSVGKYSASVKAVVTPLPRNRVDLKLVFQEGVSAKIQQINIVGNHAFSTEELISHFQLRDEVPWWNVVGDRKYQKQKLAGDLETLRSYYLDRGYARFNIDSTQVSLTPDKKGIYITVNITEGDQYKLSGVQVSGNLAGHSAEIEKLTKIEPGELYNGTKVTKMEDDIKKLLGRYGYAYPRVQSQPEINDADKTVKLRVNVDAGNRFYVRKIRFEGNDTSKDSVLRREMRQMEGAWLGSDLVDQGKERLNRLGFFETVDTDTQRVPGSPDQVDVVYKVKERNTGSFNFGIGYGTESGVSFQAGVQQDNWLGTGYSVGINGTKNDYQTYSELSVTNPYFTVDGVSLGGRIFYNDFEADDADLSDYTNKSYGTDVTLGFPINEYNTLRAGLGYVHNKLSNMQPQIAMDRYLESMGDPDASDFAADDFTFNYGWTYNKLDRGYFPTDGSRVNLTGKVTIPGSDNEYYKVSLDTATYVPIDNDHKWVVLGRTRWGYGDGLGGKEMPFYENFYAGGSSTVRGFQSNTIGPKAVYKNGAHTSWDDDDDYEDCTQESGCKSDDAVGGNAMAVASLEFITPTPFISEKYANSVRTSFFWDMGTVWDTNWDPSSAPSDVPDYSDPGNIRMSAGIALQWMSPLGPLVFSYAQPFKKYDGDKAEQFQFNIGKTW

SEQ ID NO: 1382 - protein, 786 aa, Salmonella enterica
MKKRIPTLLATMIASALYSHQGLAADLASQCMLGVPSYDRPLVKGDTNDLPVTINADNAKGNYPDDAVFTGNVDIMQGNSRLQADEVQLHQKQAEGQPEPVRTVDALGNVHYDDNQVILKGPKGWANLNTKDTNVWEGDYQMVGRQGRGKADLMKQRGENRYTILENGSFTSCLPGSDTWSVVGSEVIHDREEQVAEIWNARFKVGPVPIFYSPYLQLPVGDKRRSGFLIPNAKYTTKNYFEFYLPYYWNIAPNMDATITPHYMHRRGNIMWENEFRYLTQAGEGVMELDYLPSDKVYEDDHPKEGDKHRWLFYWQHSGVMDQVWRFNVDYTKVSDSSYFNDFDSKYGSSTDGYATQKFSVGYAVQNFDATVSTKQFQVFNDQNTSSYSAEPQLDVNYYHNDLGPFDTRIYGQAVHFVNTKDNMPEATRVHLEPTINLPLSNRWGSLNTEAKLMATHYQQTNLDSYNSDPNNKNKLEDSVNRVMPQFKVDGKLIFERDMAMLAPGYTQTLEPRVQYLYVPYRDQSGIYNYDSSLLQSDYNGLFRDRTYGGLDRIASANQVTTGVTTRIYDDAAVERFNVSVGQIYYFTESRTGDDNIKWENDDKTGSLVWAGDTYWRISERWGLRSGVQYDTRLDSVATSSSSLEYRRDQDRLVQLNYRYASPEYIQATLPSYYSTAEQYKNGINQVGAVASWPIADRWSIVGAYYFDTNSSKPADQMLGLQYNSCCYAIRVGYERKLNGWDNDKQHAIYDNAIGFNIELRGLSSNYGLGTQEMLRSNILPYQSSM

SEQ ID NO: 1383 - protein, 751 aa, Salmonella enterica
MNKKIHSLTLLVNLGIYGATLPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 1384 - protein, 726 aa, Salmonella enterica; identical to SEQ ID NO: 1368

SEQ ID NO: 1385 - protein, 663 aa, Salmonella enterica; identical to SEQ ID NO: 1369

SEQ ID NO: 1386 - protein, 491 aa, Salmonella enterica; identical to SEQ ID NO: 1373

SEQ ID NO: 1387 - protein, 342 aa, Salmonella enterica
VKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTADEHLYGNGDRATVYTGGLKYDANNIYLAAQYSQTYNATRFGTSNGNNKSTSYGFANKAQNFEVVAQYQFDFGLRPSVAYLQSKGKDISNGYGASYGDQDIVKYVDVGATYYFNKNMST

SEQ ID NO: 1388 - protein, 362 aa, Salmonella enterica; identical to SEQ ID NO: 1375

SEQ ID NO: 1389 - protein, 350 aa, Salmonella enterica
MKKTAIAIAVALAGFATVAQAAPKDNTWYAGAKLGWSQYHDTGFIHNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 1390 - protein, 751 aa, Salmonella enterica; identical to SEQ ID NO: 1367

SEQ ID NO: 1391 - protein, 726 aa, Salmonella enterica
MGMRVKKFIWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAVARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 1392 - protein, 663 aa, Salmonella enterica; identical to SEQ ID NO: 1369

SEQ ID NO: 1393 - protein, 378 aa, Salmonella enterica
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 1394 - protein, 362 aa, Salmonella enterica; identical to SEQ ID NO: 1375

SEQ ID NO: 1395 - protein, 350 aa, Salmonella enterica; identical to SEQ ID NO: 1389

SEQ ID NO: 1396 - protein, 751 aa, Salmonella enterica; identical to SEQ ID NO: 1383

SEQ ID NO: 1397 - protein, 726 aa, Salmonella enterica; identical to SEQ ID NO: 1391

SEQ ID NO: 1398 - protein, 663 aa, Salmonella enterica
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 1399 - protein, 504 aa, Salmonella enterica
AQVINTNSLSLLTQNNLNKSQSSLSSAIERLSSGLRINSAKDDAAGQAIANRFTSNIKGLTQASRNANDGISIAQTTEGALNEINNNLQRVRELSVQATNGTNSDSDLKSIQDEIQQRLEEIDRVSNQTQFNGVKVLSQDNQMKIQVGANDGETITIDLQKIDVKSLGLDGFNVNGPKEATVGDLKSSFKNVTGYDTYAAGADKYRVDINSGAVVTDAAAPDKVYVNAANGQLTTDDAENNTAVDLFKTTKSTAGTAEAKAIAGAIKGGKEGDTFDYKGVTFTIDTKTGDGGNGKVSTTINGEKVTLTVADIATGATNVNAATLQSSKNVYTSVVNGQFTFDDKTKNESAKLSDLEANNAVKGESKITVNGAEYTANATGDKITLAGKTMFIDKTASGVSTLINEDAAAAKKSTANPLASIDSALSKVDAVRSSLGAIQNRFDSAITNLGNTVTNLNSARSRIEDADYATEVSNMSKAQILQQAGTSVLAQANQVPQNVLSLLR

SEQ ID NO: 1400 - protein, 491 aa, Salmonella enterica
MQMKKLLPILIGLSLSGFSTLSQAENLMQVYQQARLSNPELRKSAADRDAAFEKINEARSPLLPQLGLGADYTYSNGYRDANGINSNETSASLQLTQTLFDMSKWRGLTLQEKAAGIQDVTYQTDQQTLILNTANAYFKVLNAIDVLSYTQAQKEAIYRQLDQTTQRFNVGLVAITDVQNARAQYDTVLANEVTVRNNLDNAVEELRQVTGNYYPELASLNVEHFKTDKPKAVNALLKEAENRNLSLLQARLSQDLAREQIRQAQDGHLPTLNLTPSTGISDTSYSGSKTNAAQYDDSNMGQNKIGLNFSLPLYQGGMVNSQVKQAQYNFVGASEQLESAHRSVVQTVRSSFNNINASISSINAYKQAVVSAQSSLDAMEAGYSVGTRTIVDVLDATTTLYDAKQQLANARYTYLINQLNIKYALGTLNEQDLLALNSTLGKPIPTSPESVAPETPDQDCAADGYNAHSAAPAVQPTAARANSNNGNPFRH

SEQ ID NO: 1401 - protein, 493 aa, Salmonella enterica
LTQNNLNKSQSSLSSAIERLSSGLRINSAKDDAAGQAIANRFTSNIKGLTQASRNANDGISIAQTTEGALNEINNNLQRVRELSVQATNGTNSDSDLKSIQDEIQQRLEEIDRVSNQTQFNGVKVLSQDNQMKIQVGANDGETITIDLQKIDVKSLGLDGFNVNGPKEATVGDLKSSFKNVTGYDTYAAGADKYRVDINSGAVVTDAAAPDKVYVNAANGQLTTDDAENNTAVDLFKTTKSTAGTAEAKAIRGAIKGGKEGDTFDYKGVTFTIDTKTGDDGNGKVSTTINGEKVTLTVADIATGATDVNAATLQSSKNVYTSVVNGQFTFDDKTKNESAKLSDLEANNAVKGESKITVNGAEYTANATGDKITLAGKTMFIDKTASGVSTLINEDAAAAKKSTANPLASIDSALSKVDAVRSSLGAIQNRFDSAITNLGNTVTNLNSARSRIEDADYATEVSNMSKAQILQQAGTSVLAQANQVPQNVLSLLR

SEQ ID NO: 1402 - protein, 403 aa, Salmonella enterica
MSFSQAVSGLNAAATNLDVIGNNIANSATYGFKSGTASFADMFAGSKVGLGVKVAGITQDFTDGTTTNTGRGLDVAISQNGFFRLVDSNGSVFYSRNGQFKLDENRNLVNMQGMQLTGYPATGTPPTIQQGANPAPITIPNTLMAAKSTTTASMQINLNSTDPVPSKTPFSVSDADSYNKKGTVTVYDSQGNAHDMNVYFVKTKDNEWAVYTHDSSDPAATAPTTASTTLKFNENGILESGGTVNITTGTINGATAATFSLSFLNSMQQNTGANNIVATNQNGYKPGDLVSYQINNDGTVVGNYSNEQEQVLGQIVLANFANNEGLASQGDNVWAATQASGVALLGTAGSGNFGKLTNGALEASNVDLSKELVNMIVAQRNYQSNAQTIKTQDQILNTLVNLR

SEQ ID NO: 1403 - protein, 377 aa, Salmonella enterica
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDGINTDDIVALGLVYQF

SEQ ID NO: 1404 - protein, 350 aa, Salmonella enterica; identical to SEQ ID NO: 1389

SEQ ID NO: 1405 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDNDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 1406 - protein, 747 aa, Escherichia coli
MARSKTAQPKHSLRKIAVVVATAVSGMSVYAQAAVELKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 1407 - protein, 669 aa, Escherichia coli
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 1408 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDINMRGYDHRGVLVLVDGIRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 1409 - protein, 585 aa, Escherichia coli
  misc_feature (337)..(337): Xaa can be any naturally occurring amino acid
MAQVINTNSLSLITQNNINKNQSALSSSIERLSSGLRINSAKDDAAGQAIANRFTSNIKGLTQAARNANDGISVAQTTEGALSEINNNLQRIRELTVQATTGTNSDSDLDSIQDEIKSRLDEIDRVSGQTQFNGVNVLAKDGSMKIQVGANDGETITIDLKKIDSDTLGLNGFNVNGKGTITNKAATVSDLTSAGAKLNTTTGLYDLKTENTLLTTDAAFDKLGNGDKVTVGGVDYTYNAKSGDFTTTKSTAGTGVDAAAQAADSASKRDALAATLHADVGKSVNGSYTTKDGTVSFETDSAGNITIGGSQAYVDDAGNLTTNNAGSAAKADMKALXKAASEGSDGASLTFNGTEYTIAKATPATTTPVAPLIPGGITYQATVSKDVVLSETKAAAATSSITFNSGVLSKTIGFTAGESSDAAKSYVDDKGGITNVADYTVSYSVNKDNGSVTVAGYASATDTNKDYAPAIGTAVNVNSAGKITTETTSAGSATTNPLAALDDAISSIDKFRSSLGAIQNRLDSAVTNLNNTTTNLSEAQSRIQDADYATEVSNMSKAQIIQQAGNSVLAKANQVPQQVLSLLQG

SEQ ID NO: 1410 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGGSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 1411 - protein, 495 aa, Escherichia coli
MQMKKLLPILIGLSLSGFSSLSQAENLMQVYQQARLSNPELRKSAADRDAAFEKINEARSPLLPQLGLGADYTYSNGYRDANGINSNATSASLQLTQSIFDMSKWRALTLQEKAAGIQDVTYQTDQQTLILNTATAYFNVLNAIDVLSYTQAQKEAIYRQLDQTTQRFNVGLVAITDVQNARAQYDTVLANEVTARNNLDNAVEQLRQITGNYYPELAALNVENFKTDKPQPVNALLKEAEKRNLSLLQARLSQDLAREQIRQAQDGHLPTLDLTASSGISDTSYSGSKTRGAAGTQYDDSNMGQNKVGLSFSLPIYQGGMVNSQVKQAQYNFVGASEQLESAHRSVVQTVRSSFNNINASISSINAYKQAVVSAQSSLDAMEAGYSVGTRTIVDVLDATTTLYNAKQELANARYNYLINQLNIKSALGTLNEQDLLALNNALSKPVSTNPENVAPQTPEQNAIADGYAPDSPAPVVQQTSARTTTSNGHNPFRN

SEQ ID NO: 1412 - protein, 367 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 1413 - protein, 346 aa, Escherichia coli
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 1414 - protein, 167 aa, Escherichia coli [sequence omitted]

SEQ ID NO: 1415 - protein, 784 aa, Escherichia coli
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 1416 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 1417 - protein, 725 aa, Escherichia coli
MRINKILWSLTVLLVGLNSQVSVAKSSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSDEGATRRANFSLSGPLAGNALTTRLYGNLNKTDADSWDINSPVGTKNAAGHEGVRNKDINGVVSWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDSDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 1418 - protein, 682 aa, Escherichia coli
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 1419 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVGASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 1420 - protein, 495 aa, Escherichia coli; identical to SEQ ID NO: 1411

SEQ ID NO: 1421 - protein, 436 aa, Escherichia coli
MAQVINTNSLSLITQNNINKNQSALSTSIERLSSGLRINSAKDDAAGQAIANRFTSNIKGLTQAARNANDGISLAQTTEGALSEINNNLQRVRELTVQATTGTNSDSDLSSIQDEIKSRLDEIDRVSGQTQFNGVNVLAKDGSMKIQVGANDGQTISIDLQKIDSSTLGLNGFSVSGQSLNVSDSITQITGAAGTKPVGVDFTAVAKDLTTATGKTVDVSSLTLHNTLDAKGAATSQFVVQSGNDFYSASINHTDGKVTLNKADVEYTDTDNGLTTAATQKDQLIKVAADSDGSAAGYVTFQGKNYATTVSTALDDNTAAKATDNKVVVELSTAKPTAQFSGASSADPLALLDKAIAQVDTFRSSLGAVQNRLDSAVTNLNNTTTNLSEAQSRIQDADYATEVSNMSKAQIIQQAGNSVLSKANQVPQQVLSLLQG

SEQ ID NO: 1422 - protein, 366 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLFYQF

SEQ ID NO: 1423 - protein, 380 aa, Escherichia coli
MNIYRAVTSFFNKSSKKGRTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 1424 - protein, 346 aa, Escherichia coli
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQALSERRAQSVVDYLISKGIPADKISARGMGESNPVTGNTCDNVKQRAALIDCLAPDRRVEIEVKGIKDVVTQPQA

SEQ ID NO: 1425 - protein, 307 aa, Escherichia coli
MVSTTYLWYKARRTSDPFRIHRLDGSDNLTLCNNTHVSAHIPGCPLGSVIWDTWRHNPNFYIEVLIMATVSMRDMLKAGVHFGHQTRYWNPKMKPFIFGARNKVHIINLEKTVPMFNEALAELNKIASRKGKILFVGTKRAASEAVKDAALSCDQFFVNHRWLGGMLTNWKTVRQSIKRLKDLETQSQDGTFDKLTKKEALMRTRELEKLENSLGGIKDMGGLPDALFVIDADHEHIAIKEANNLGIPVFAIVDTNSDPDGVDFVIPGNDDAIRAVTLYLGAVAATVREGRSQDLASQAEESFVEAE

SEQ ID NO: 1426 - protein, 167 aa, Escherichia coli
MSTAKLVKSKATNLLYTRNDVSDSEKKATVELLNRQVIQFIDLSLITKQAHWNMRGANFIAVHEMLDGFRTALIDHLDTMAERAVQLGGVALGTTQVINSKTPLKSYPLDIHNVQDHLKELADRYAIVANDVRKAIGEAKDDDTADILTAASRDLDKFLWFIECNIE

SEQ ID NO: 1427 - protein, 167 aa, Escherichia coli [sequence omitted]

SEQ ID NO: 1428 - protein, 746 aa, Escherichia coli; identical to SEQ ID NO: 1416

SEQ ID NO: 1429 - protein, 774 aa, Escherichia coli
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 1430 - protein, 725 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNMHHIEVIFGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIGAGKATSADAFWRLSRLRHFLFNAGLLMHITEPQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGPPLV

SEQ ID NO: 1431 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 1432 - protein, 495 aa, Escherichia coli; identical to SEQ ID NO: 1411

SEQ ID NO: 1433 - protein, 421 aa, Escherichia coli
VDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGNADNNANFGKAVPADFNGGSFGRGDSDEWTFGAQMEIWW

SEQ ID NO: 1434 - protein, 448 aa, Escherichia coli
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 1435 - protein, 380 aa, Escherichia coli; identical to SEQ ID NO: 1423

SEQ ID NO: 1436 - protein, 161 aa, Escherichia coli
DDLDIYTRLGGMVWRADTKANVPGGASYKDHDTGVSPVFAGGVEYAITPEIATRLEYQWTNNIGDAHTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGS

SEQ ID NO: 1437 - protein, 241 aa, Escherichia coli
MATVSMRDMLKAGVHFGHQTRYWNPKMKPFIFGARNKVHIINLEKTVPMFNEALAELNKIASRKGKILFVGTKRAASEAVKDAALSCDQFFVNHRWLGGMLTNWKTVRQSIKRLKDLETQSQDGTFDKLTKKEALMRTRELEKLENSLGGIKDMGGLPDALFVIDADHEHIAIKEANNLGIPVFAIVDTNSDPDGVDFVIPGNDDAIRAVTLYLGAVAATVREGRSQDLASQAEESFVEAE

SEQ ID NO: 1438 - protein, 294 aa, Escherichia coli
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKIKYFVPITDLWGGQLSYIGFTNFDWGSDLGDDSGBAINGIKTRTNNSIASSHILALNYDHWHYSVVARYWHDGGQWNDDAELNFGNGNFNVRSTGWGGYLVVGYNF

SEQ ID NO: 1439 - protein, 167 aa, Escherichia coli; identical to SEQ ID NO: 1426

SEQ ID NO: 1440 - protein, 167 aa, Escherichia coli [sequence omitted]

SEQ ID NO: 1441 - protein, 810 aa, Escherichia coli
MAMKKLLIASLLFSSATVYGAEGFVVKDIHFEGLQRVAVGAALLSMPVRTGDTVNDEDISNTIRALFATGNFEDVRVLRDGDTLLVQVKERPTIASITFSGNKSVKDDMLKQNLQASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRIYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSRDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTYNKLDRGYFPTDGSRVNLTGKVTIPGSDNEYYKVTLDTATYVPIDDDHKWVVLGCTRWGYGDGLGGKEMPFYENFYAGGSSTVRGFQSNTIGPKAVYFPHQASNYDPDYDYECATQDGAKDLCKSDDAVGGNAMTVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 1442 - protein, 784 aa, Escherichia coli
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 1443 - protein, 724 aa, Escherichia coli
  misc_feature (52)..(52): Xaa can be any naturally occurring amino acid
  misc_feature (77)..(77): Xaa can be any naturally occurring amino acid
  misc_feature (118)..(118): Xaa can be any naturally occurring amino acid
  misc_feature (346)..(346): Xaa can be any naturally occurring amino acid
  misc_feature (374)..(374): Xaa can be any naturally occurring amino acid
  misc_feature (418)..(418): Xaa can be any naturally occurring amino acid
  misc_feature (460)..(460): Xaa can be any naturally occurring amino acid
  misc_feature (579)..(579): Xaa can be any naturally occurring amino acid
  misc_feature (587)..(587): Xaa can be any naturally occurring amino acid
  misc_feature (621)..(621): Xaa can be any naturally occurring amino acid
  misc_feature (718)..(718): Xaa can be any naturally occurring amino acid
QEPTDTPVSHDDTIVVTAAEQNLQAPGVSTITADEIRKNPVARDVSKIIRTXPGVNLTGNSTSGQRGNNRQIDIRGXGPENTLILIDGKPVSSRNSVRQGWRGERDTRGDTSWVPPEXIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVXLHSEVNLPIDFLVNQTLTLGTEWNQQRXKDLSSNTQALTGTNTGGAIDGVSTTDRSPYSKAEIFSLFAENNXELTDSTIVTPGLRFDHHSIVGNNWSPALNISQGLGDDFTLKXGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVXWTNNITYXLKSENKTTGDRLSIIPEYTLNSTLSWQAREDLSXQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYXSVNTHF

SEQ ID NO: 1444 - protein, 774 aa, Escherichia coli; identical to SEQ ID NO: 1429

SEQ ID NO: 1445 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDRIEVISGATSLYGGGSTGGLINIVTKKGQPETIMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 1446 - protein, 614 aa, Escherichia coli; identical to SEQ ID NO: 1431

SEQ ID NO: 1447 - protein, 365 aa, Escherichia coli
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 1448 - protein, 346 aa, Escherichia coli; identical to SEQ ID NO: 1413

What is claimed is:

1. A method comprising:

induction production in an animal of antibody that specifically binds an iron regulated polypeptide isolated from *Salmonella enterica* serovar Newport strain MS020508, which is deposited with the American Type Culture Collection (ATCC) under Accession No. PTA-9496, grown in culture medium containing 2,2-dipyridyl;

wherein the inducing the production of the antibody in the animal comprises administering to the animal an effective amount of a composition comprising:

a first isolated iron regulated polypeptide isolated from *Salmonella enterica* serovar Newport having a molecular weight of about 82 kDa as measured following electrophoresis on an SDS-polyacrylamide gel, wherein the first isolated iron regulated polypeptide, if digested with trypsin, produces polypeptide fragments having masses of 628.39 Da±300 parts per million (ppm), 643.37 Da±300 ppm, 771.42 Da±300 ppm, 830.45 Da±300 ppm, 872.46 Da±300 ppm, 990.55 Da±300 ppm, 1082.61 Da±300 ppm, 1207.58 Da±300 ppm, 1324.75 Da±300 ppm, 1377.66 Da±300 ppm, 1463.74 Da±300 ppm, 1499.71 Da±300 ppm, 1633.84 Da±300 ppm, 1618.77 Da±300 ppm, 1727.83 Da±300 ppm, 1871.88 Da±300 ppm, 1980.96 Da±300 ppm, 1997.06 Da±300 ppm, 2192.94 Da±300 ppm, and 2331.05 Da±300 ppm;

a second isolated iron regulated polypeptide isolated from *Salmonella enterica* serovar Newport having a molecular weight of about 80 kDa as measured following electrophoresis on an SDS-polyacrylamide gel, wherein the second isolated iron regulated polypeptide, if digested with trypsin, produces polypeptide fragments having masses of 848.45 Da±300 ppm, 918.45 Da±300 ppm, 1040.60 Da±300 ppm, 1097.62 Da±300 ppm, 1309.63 Da±300 ppm, 1335.71 Da±300 ppm, 1341.66 Da±300 ppm, 1364.60 Da±300 ppm, 1528.70 Da±300 ppm, 1564.76 Da±300 ppm, 1735.86 Da±300 ppm, 1750.86 Da±300 ppm, 1754.83 Da±300 ppm, 1845.91 Da±300 ppm, 1911.98 Da±300 ppm, 1929.04 Da±300 ppm, 1935.01 Da±300 ppm, 2030.93 Da±300 ppm, 2416.14 Da±300 ppm, 2587.35 Da±300 ppm, 2701.36 Da±300 ppm, 2909.36 Da±300 ppm, and 2943.50 Da±300 ppm;

a third isolated iron regulated polypeptide isolated from *Salmonella enterica* serovar Newport having a molecular weight of about 74 kDa as measured following electrophoresis on an SDS-polyacrylamide gel, wherein the third isolated iron regulated polypeptide, if digested with trypsin, produces polypeptide fragments having masses of 605.33 Da±300 ppm, 616.37 Da±300 ppm, 808.41 Da±300 ppm, 1063.48 Da±300 ppm, 1158.55 Da±300 ppm, 1210.55 Da±300 ppm, 1314.62 Da±300 ppm, 1329.77 Da±300 ppm, 1345.55 Da±300 ppm, 1526.73 Da±300 ppm, 1649.90 Da±300 ppm, 1677.74 Da±300 ppm, 1740.90 Da±300 ppm, 1744.69 Da±300 ppm, 1750.84 Da±300 ppm, 1792.88 Da±300 ppm, 1814.85 Da±300 ppm, 1906.92 Da±300 ppm, 1934.88 Da±300 ppm, 1952.94 Da±300 ppm, 1987.04 Da±300 ppm, 2242.03 Da±300 ppm, 2538.26 Da±300 ppm, 2587.24 Da±300 ppm, and 2710.17 Da±300 ppm;

a fourth isolated iron regulated polypeptide isolated from *Salmonella enterica* serovar Newport having a molecular weight of about 65 kDa as measured following electrophoresis on an SDS-polyacrylamide gel, wherein the fourth isolated iron regulated polypeptide, if digested with trypsin, produces polypeptide fragments having masses of 1303.65 Da±300 ppm, 1398.57 Da±300 ppm, 1508.73 Da±300 ppm, 1792.85 Da±300 ppm, 1868.85 Da±300 ppm, 1932.87 Da±300 ppm, 2023.92 Da±300 ppm, 2086.08 Da±300 ppm, and 2257.21 Da±300 ppm; and a pharmaceutically acceptable carrier.

2. The method of claim 1 wherein the animal is avian, bovine, caprine, ovine, porcine, bison, a companion animal, a member of the family Cervidae, or human.

3. The method of claim 1 wherein the animal has or is at risk of infection by a gram negative microbe.

4. The method of claim 1 wherein the method further comprises collecting the antibody from the animal.

5. The method of claim 4 wherein the method further comprises isolating the antibody.

6. The method of claim 4 wherein the method further comprises administering the collected antibody to another animal.

7. The method of claim 6 wherein the antibody is administered topically.

8. The method of claim 1 wherein the composition comprises lipopolysaccharide (LPS) wherein the amount of the LPS is less than 50% of the LPS present in a second composition comprising the first, the second, the third, and the fourth isolated iron regulated polypeptides that is produced by a process comprising:

providing the *S. enterica* serovar Newport strain MS020508 deposited with the American Type Culture Collection (ATCC) under Accession No. PTA-9496 after growth in culture medium containing 2,2-dipyridyl, disrupting the *S. enterica* serovar Newport strain MS020508, and isolating the first, the second, the third, and the fourth iron regulated polypeptides of the second composition.

9. The method of claim 1 wherein:
the first isolated iron regulated polypeptide has a molecular weight of 82 kDa as measured following the electrophoresis on the SDS-polyacrylamide gel;
the second isolated iron regulated polypeptide has a molecular weight of 80 kDa as measured following the electrophoresis on the SDS-polyacrylamide gel;
the third isolated iron regulated polypeptide has a molecular weight of 74 kDa as measured following the electrophoresis on the SDS-polyacrylamide gel; and
the fourth isolated iron regulated polypeptide has a molecular weight of 65 kDa as measured following the electrophoresis on the SDS-polyacrylamide gel.

* * * * *